United States Patent 11,739,335 (NUCLEIC ACIDS ENCODING CRISPR-ASSOCIATED PROTEINS AND USES THEREOF) - sequence listing, part 6

SEQ ID NO: 4443 - RNA, 4197 nt, Artificial Sequence
  Cas9 variant
auggaaaagagcuacuccaucggccuggacauugggaccaacucugugggauggagcgucaucacagaugacuauaaaguucccgccaagaaaaugagagugcucggcaauacggauaagaaauacauuaagaagaaccugcuuggggcucugcuuuucgacuccggagaaaccgccgaggcgacacggcugaaacgcaccgcuagacggcgcuauacaagacggaagaaucgccuuagauaccugcaggaaaucuuugccaaagagauggccaagguggaugaaucuuucuuucaacggcucgacgagagcuuccugaccgaugacgauaaaacauuugacucccacccuauuuucggcaacaaggcugaggaagaugccuaucaucagaaguuuccgaccaucuaccaucugcgcaaacaccucgcugacucucaggagaaggccgaucugagacuuaucuaucuggcgcucgcccacaugauuaaauuccgggggcauuuucuguacgacaauuucaacgacgauaauuuugacuggcgcaacaucgauauucagaagagauacgaagaguucaucgagacguaugacagcacccuuggagaauccuaccuggcugauauuagcgucgacgccgcuucuauccucgaggaaaaaguguccaagacagagcggcuggaaaaucugcucaaauauuaccccaccgagaagaagacaaccuuuuucggcaaccugauuaaacuuauccugggccaacaggccaaguucaaagcgaucuuuaaucucgaggaugaaauuagccugcaguucgccacgccuacauaugacgaggaucuugaggagcugcucgggaagaucgacaacggagauucuuacuccgaacuguuuguugcugcccagaaucuguauaacaccauucuccuggcuagcuuccuuaaaacagacaauaagucugccaaggcuccccuguccaccagcaugaucgagcgcuacgagaaccacaaaaaggaccucgccaaacugaaggauuuugugaaaaagaacugcccugaccaauaccacgauauuuucagagacaaguccaaaaauggcuaugcgggguacaucgauaacggagucucucagaaugacuuuuauaccuucaucggcaagugucuugaagagagccugaaaaaggauaaaggggcccaguacuuucucgacaagauugaucgggacgauuuccugagaaagcagcgcacauuugacaacggagcuuuccccuaucaaauccaucugcaggaaaugcacgccauucuccggagacagggcgauuacuauccuuuucugaaagagaaucaagacaagaucgaaaagauucuuacguuccgcaucccguacuacgugggcccccuggcccggaaggacuccagauucgcuugggccaacuaucgcagcgaugaggcgaucaccccuuggaauuuugacgagguuguggauaaagaaaagucugcugagaaauucauuacacggaugacccucaacgaccuguaccugcccgaagagaagguccuuccuaagcauucccucaucuaugagacauuuaccguguacaaugaacugacgaacauuaaauaugugaaugaucaggggaacgccauccacuucgacagcgagcugaaggagaaaauuuuuaaucaacucuucaaggaaaacagaaaagucucuaagaagacacugaucgauuuucuuaauaacagcgaaggaauuuacaccgacaaacugguuggcaucgaugaggaggugaaguaucucaacgccucccuggggaccuaccacgaccugaaaaagauccuugaaucuuucauggaugacgagauuaaugagaaaaucauugaagauaucauucagacacucacccuguuugaagacaucgagaugaagcgccagcggcugcagaaguacgacgauaucuucacacccaaacagcucaaggagcuggcuagacgcaacuauacgggauggggccggcuuagcuacaaacugauuaaugggaucagaaacaaggaaaauaacaaaaccauucucgacuaucugaagaauggaaaccggaauuuuaugcagcugaucaacgaugaccgccuuuccuucaagcaaauuaucaucgaugccagaaaaauugagaagcucgacaauaucgaaagcguggucuacaaccugccgggcucuccugcuauuaaaaagggcauccugcaguccauuaaaaucguggaugagcucguuaaggugauggggcauaaucccgacaacaucgucauugaaauggcccgggagaaucagacaaccaaccagggcaaaaacagaagccaacagcgccugaagcggcuucaggauucuauguccaauuuuaaggacagcuccaucucucugaaagauguggacaacagcgaccuccagaaugauagacuguuccuguauuacauucaaaacggaaaggacauguauacaggggaggaacuugauaucgaccaccucuccgauuacgacauugaucauaucauuccucagucuuucaucaaagacaauagcaucgauaaccgcguucugaccuccagcgcgaagaauagaggaaaaucugacgaugugcccggccgggacgucgugcugaagaugaagcccuuuuggaaaaagcucuacgaugucaaacugauuuccaagcgcaaauucgacaaccuuaccaagagcgagcacgggggccugacggaaucugacaaggccggauuuaucaaaagacagcucguggagacacggcaaauuaccaaguauguugcucagauccuggauggccgcuucaauacaaaaagagacgauaacaauaaggugauucgggacgucaaagugaucacccugaaguccagccuuguuucucaguuucgcaaggauuucggguuuuacaaagugagagagaucaacgacuaucaucacgcccacgaugcuuaccugaaugccgucgugggaacggcgauucucaagaaauauccuaagcuggccccggaauuuguguacggcgaguauaaaaagugcgacguucggaagcucaucgcuaaaagcggggauaaguccgaaauuggaaaagccacagcuaaguacuuuuucuacagcaaccugaugaauuucuucaaacgcgucaucagauauucuaacggcaugauuguggugcggcccgucaucgaguacuccaaggacaccggggaaaucgccugggauaaagagaaggacuucaagacaguguguaaaguucuuagcugcccucaggugaacauugucaagaaaguggagaagcaaucccauggccuggauagaggaaaacccaagggcuuuuauaaugccaacccuucucccaagccgaaaaaggggagcaaaguuaaucucgugccuaucaaggcuaaccugaaucccaaaaacuacggaggcuaugcggggauuuccaauucuuacgccguccugguggacgcuaccaucgaaaagggagccaagaaaaagcucacccgcauucaggaguuccagggcaucagcauuaucgaccgggaaaaauaugagaagaacaaaguugaauuucugaaggggcucggcuacaaggagaucuacuccauuaucacacugccuaaauauucucucuucgagcuggccgauggaagcagacgcaugcuugcuuccauucugagcacgaauaacaagcggggcgaaauccacaaagggaaugagcucgugcugcccgccaaguacauuccucugcuuuaucaugcgaacagaauccacaauaccuuugaaacaggacaccgcgaguacgucgaaaaacauaucgcugaguucaaggagauugccgaaaucauucuggaguuuaacaauaaauaugugaacgccaagaaaaauucuuccaucauugaaaaagcucucgagagcuucgacucuuuuucccuggaugagaucugugacagcuucgugggcaagcucaaaaagaacaacaccaaaaagaacucugggcuguuugaacuugucucccugggaagcgccuccgauuucgaguuucuggaaacaaagguuccccgguacagagacuauaccccgagcucucuccugaaugcgacgcuuauccaccagagcauuacaggccuguacgagacccgcaucgaucucuccaaacugggggaagaguga

SEQ ID NO: 4444 - RNA, 4197 nt, Artificial Sequence
  Cas9 variant
auggagacccaggccagcaaccaacugaucuccucucaccucaagggcuaccccauuaaagacuauuucguggggcuggauaucggaacaagcuccgucggcugggcuguuacgaauaaggccuacgaacuucugaaauuuagaucucauaagaugugggggagcagacucuucgacgagggagaauccgcgguggcucgcagaggcuuucggucuaugcgcagacggcuggagcgcagaaaacuucggcugaagcuccuggaggaacuguucgccgaugccauggcucagguggacccuaccuuuuucaugcgccucagagagagcaaguaucacuacgaagauaaaacaaccgggcauuccagcaagcacauucuguuuaucgacaaaaacuauacagaucaggacuacuauaaggccuacccgaccauuuaccaucuucgggcugagcugaugaaagauggaacauaugacauccgcaaacucuuccuggccguccaccacauccuuaaguacagaggcaauuuucuguaugaaggcgcgucuuucgauuccaacgccagcacccucgacgaugugcugaaacaggcucuggagaauauuacguuuaacugcuucgacucuuccgccgcuaucgggagcauuggacaaauccucauggagaccggcaagacaaaaucugacaaggccaaaaccauugaacggcugguugauacauacaucauuaccgacgaggugaaugcguccgggaagacgcagaaagaucaggucaaggaagacaagaaacgccuuaaggccuuugcuaaccuggugcucggacugaaugccagccuuaucgaucuguucggcuccguugaggaacucgaggaggaccugaaaaagcugcagaucacaggggauaccuaugacgauaaaagagacgaacucgcuaaggccuggucugaugagauuuacaucauugacgacuguaagagcguguaugaugccaucauucugcuuuccaucaaagaacccggacugacaaucagcgagucuaaggucaaggcuuucaacaagcauaaagacgaucucgcgauucugaagucccuucucaagagcgaccggucuaucuacaaugccauguuuaaaguggaugaaaagggccugcacaacuacgugcauuauauuaaacaaggcagaaccgaggagaccagcugcaaucgcgaagacuucuacaaguauaccaaaaaggucguugaggggcugccugauuccaaggacaaagaauacauccugucugagauugaacuccagacgcugcuuccccugcagcggaucaaggauaacggagugaucccuuaucagcuccaccuggaggagcugaaagugauucuugcuaaguguggccccaaauuuccuuuccucaaugaagucgccgacggguuuagcguggccgagaagcugaucaaaaugcuggaguuccggauuccguacuauguuggaccccucaacaccucccacaacguggauaauggcggguuugcuugggccguccgcaaggcgagcggacgggugacaccuuggaacuucgacgauaagaucgacagagaaaaaucugcugccgccuuuauuaagaaucugaccaacaaaugcacauaccuucugggcgaggacguucuccccaaguccagccugcuguacucugaguucaugcuucucaaugaacugaacaaugugcgcaucgauggcaaaccucuggaaaccaaggucaaggcucaucucauuaaagccguguuuaagcaagaccacaaaaagaugacgaaaaaccggaucgagcaguuccugaaggauaauaacuauauccccgaaaagcauaaaccggagauuacagggcuugacggagagaucaagaaugaucuggcuuccuacagagacaugguccgcauucucggcaacaauuuugaucugagcauggccgaagagaucauuaccgacaucaccaucuucggggaauccaaaaagaugcugcgggagacacuucgcaaaaaguucgcgucuugucucgaugacgaagccauuaagaaacugagcaagcugagauaucgggauuggggaagacucuccaaaaagcugcuuaacggcaucgacgggugcgauaaagcuggcgacggaaccucugugacaauuaucgaggccaugcgggacuuuagcuacaaucugauggagcuccugggcgaucgcuuccuguuuauggaacggauucaggagaucaacgacaaacuuacggaagggcaaaucguuaacccucacgauauuaucgacgaucucgcucugucccccgccgugaaaagagcggucuggcaggcccugagaauuguggacgagaucguucauauuaagaaggcucucccugcccgcaucuucguggaagucacccggagcaauaaagcugagaagaaaaagaaagauucuagacagaagcgccuguccgaccuuuaugccgccaucaagaaagaugacgcucugcucagcggacugacaaacgaggaauuuggcgggcugaagucugagcuugcgaaauacgaugacgccgcucugagauccaagaaacucuaucuguacuacacccagaugggacggugugccuauacaggcgaagugauugaccucagccaacugaauaccgauaacuacgacaucgaucacauuuauccccgcucucuuacgaaggacgauagcuucgacaaucuggugcucugcaagagaaccgccaacgcucagaaauccgauacauaccccaucagcaaggagauucagaaagcccagaaggcguuuuggaucuuccugaaacaacaggggcugauuucugagcggaaguaugaacgccuuaccagaaucacaccucugaccgcugacgaucucuccggcuuuaucgcccggcagcugguugagacgaaucagagcgucaaggccgcuacaacccuccugcgcagacuuuacccggacauugaugugguguucgucaaagccgaaaacgugacagacuuucggcacgauaauaacuucaucaagguucgcucccugaaucaucaccaucacgcgaaagacgcuuaucucaacauuguggucggaaauguguaccacgagaaguuuaccagaaacuuccgggccuucuuuaaaaagaauggcgccaacagaaccuacaaccuggcuaagauguucaauuaugacguuaaauguacaaacgccaaggaugggaaggcuugggacgugaagacgucuauggauaccgucaauaaaaugaugacaagcaacgacgugcgcguuaccaagcggcugcuugaacaauccggagcccuggcggaugccacaguguacaaagcuaccgucgccgcuaaggccaaggacggcgccuauaucgggaugaaaacgaagucuagcguguuugcugaugugacaaaauacggaggcaugaccaagauuaaaaaugcguauuccaucaucguccaguacauugggaagaagggcgagguugugaaagagaucgugccccucccuauuuaucugaccaacagaaauaucacagaccaggaucucauugacuacgucgccucuaucacaccccaggcuaaggauaucagcauuaucuaccgcaaacugugcauuaaccaacuugugaagguuaauggauucuauuacuaucugggcgggaaaacaaacuccaauaucuacauugacaacgccguggaagucgugguuccugccaauaucgcuguguauauuaagguccuggagaaguuugcccuccugcauaaagauaacaauaacaucaaggcgagcacggugaccacacggaucuacaacgaaggaucuaccaauauuguuuccaucacagacaaagacggccuuauuguguaugauuaccugaugagcaagcucagaacgccccuguacaugaaaaugaaggggaacaaggucgacgagcucucuaccgugggacgcuccaaauucaugaauaugacccuggaggaacagagcaucuaucuucuggaggugcugaaccuccugacaaauucuaagaccacauuugaugucaaagcucuuggcauuaccgccucccggagcacaaucgggguuaagauccacacccuggacgaguucaaaauuaucaaccaguccauuacgggccucuacagcaaugaaaucacaauuguguga

SEQ ID NO: 4445 - RNA, 4197 nt, Artificial Sequence
  Cas9 variant
auggagacccagacaagcaaccaacugaucacgucccaccucaaggacuaccccaaacaggauuauuucgugggccuggacauugggaccaauucugucggaugggccguuacaaacaccagcuacgaacuucugaaguuucauucccacaaaauguggggcucuagacucuucgaggaaggggagagcgcugugacacggcgcggauuuagauccaugcggcgcagacuggaacggcgcaaacuuagacugaaacuccuggaggagcuguucgccgaugcgauggcucagguggacucuaccuuuuucauccggcuccaugaaagcaaguaucacuacgaggauaagacaaccggccauuccagcaaacacauucuguuuaucgacgaagauuauacggaccaggauuacuucaccgaguauccuacaauuuaccaccuucgcaaggaccugauggagaaugggaccgaugacaucagaaaacucuuucuggccguccaucacauccuuaaguaccggggaaacuuccuguaugaaggcgccacauuuaauucuaacgcuuucaccuuugaggaugugcucaaacaagcccugguuaauauuacguucaacugcuucgacacaaauuccgcuaucagcucuauuuccaacauccugauggaaagcggcaagaccaagucugacaaagccaaggcgauugagcgccucguggauacauacaccgucuuugacgaagugaauaccccggauaaaccccagaaggagcagguuaaagaggacaagaaaacacugaaggccuucgcuaaccuugugcuggggcucuccgccaaucugaucgaucuuuuuggaagcgucgaagacauugaugacgaucugaagaaacuccagaucgugggcgacacguaugaugagaagagagacgaacuggcuaaaguguggggagacgagauccauauuaucgaugacuguaaguccgucuacgaugccauuauccugaugucuauuaaagaaccugggcucaccaucagccaauccaagguuaaggcguucgacaaacacaaggaggaucuggugauccuuaaaagccugcucaagcuggaccggaacguguauaaugagauguuuaaaucugauaagaagggccuucacaacuacguccauuauauuaaacaggggcgcacagaagagaccuccugcagcagagaagacuucuacaaguacaccaaaaagaucguggagggacuggccgauucuaaagacaaggaauauauucucaacgagaucgagcugcagacacugcucccccugcagcggauuaaggauaauggcguuaucccuuaccaacuucaccuggaggagcucaaagugauccuggacaaguguggccccaaauuuccuuuccugcauacggucagcgauggguuuuccgugacagaaaaacuuauuaaaaugcucgaguucagaaucccguauuacguuggaccccugaacacccaccauaauauugacaacggcggguuuucuugggcugugcgcaagcaggccggacgggucaccccuuggaauuucgaggaaaagaucgacagagaaaagagcgcugccgccuuuauuaagaaccugacaaauaaaugcaccuaucucuucggcgaagaugugcugcccaaguccagccuucuguacucugaguucaugcuccugaacgaacugaauaacguccgcaucgacgggaaagcucuugcgcagggagugaagcaacaccucauugauuccaucuuuaaacaggaccacaagaagaugacaaagaaucggaucgagcuguuccugaaggauaacaauuauauuacgaaaaagcauaaaccugagaucaccggccucgacggcgaaauuaagaacgaucugacaagcuacagagacaugguucgcauccuugggaauaacuuugaugugucuauggccgaggacauuaucaccgauaucacaauuuucggagaauccaagaaaaugcugcggcagacccucagaaacaaguuuggcagccagcugaaugacgagacgaucaaaaagcuguccaaacuucgcuaccgggauugggggagacucucuaagaagcugcugaaaggaauugacggcugugacaaggcugggaacggcgcccccaaaaccaucauugaacucaugcgcaaugauagcuauaaccugauggagauccuuggagacaaguucuccuuuauggagugcaucgaagaggaaaaugccaaacuggcucaaggccaggucgugaacccgcacgauauuaucgacgagcucgcccugucuccugcgguuaagcgggcuguguggcaggcccugagaauugucgaugaaguggcccauaucaaaaaggcccuucccagccggauuuucguggagguugcucgcacaaauaaguccgagaaaaagaaaaaggacagcagacagaaacggcucucugaucuguacuccgcuaucaagaaggacgauguccugcaaagcgggcuccaggacaaagaauuuggagcccugaagucuggccuugcgaacuaugaugacgccgcucugagauccaaaaagcucuaccuguauuacacccagauggggcgcugugccuauacaggaaauaucauugaccugaaccagcuuaauaccgauaacuacgacaucgaucacauuuacccucggagccugacgaaagacgauucuuucgacaaucucgugcugugcgagagaacagcuaacgccaaaaagagcgauaucuaucccauugacaaucgcauccaaaccaaacagaagcccuuuugggcguuccucaaacaccagggccugauuuccgaaagaaaguacgagcggcuuacacgcaucgccccucugaccgcugaugaccucagcggguuuaucgccagacagcugguggagaccaaccaaucugucaaagcuacaacgacccugcuucggcgccuguauccggauauugacgugguuuucgugaaggccgaaaacgucuccgauuucagacauaauaacaauuuuaucaaggugcggagccucaaccaccaucaccaugccaaagacgcuuaccugaauauuguugugggcaacgucuaucacgagaaguucacacgcaauuuuagacucuucuuuaaaaagaacggagcgaaucggaccuacaaccuggccaaaauguucaauuaugacgugaucuguacaaacgcucaggauggcaaggccugggacguuaagaccuccaugaauacggugaaaaagaugauggccucuaacgauguccgcgugacaagacggcuucuggaacagagcggggcucucgccgacgcgaccauuuacaaggcuuccguggccgccaaggcuaaagauggagccuacaucggcaugaagaccaaauauucugucuuugcggacguuacaaaguacgggggaaugaccaagaucaaaaaugcuuauagcauuaucgugcaauacacaggcaagaaaggggaggaaauuaaggagaucgugccccugccuauuuaucugaucaacagaaacgccacggauaucgagcuuauugacuacgucaaauccgugauccccaaggccaaggauauuucuaucaaauaucgcaagcugugcauuaaucagcucguuaaagugaacggcuucuacuacuaucugggaggcaagaccaaugacaaaaucuacauugauaacgcuaucgaacucgucgugccucacgacaucgccacauauauuaagcugcuugauaaguacgaccugcugcggaaagagaauaagacccucaaagcuagcuccaucacaaccagcauuuauaacaucaauacgucuaccguugugucccugagcaacaaggucgggauugacguguuugauuacuucaugucuaaacuuagaacaccccuguauaugaagaugaagggaaauaaaguugacgaacucuccagcaccggccgcucuaaguuuaucaaaaugacacuggaggaacaguccaucuaccuccuggaggugcuuaaccugcugaccaauagcaagacaaccuucgaugucaaaccgcucgggauuacgggaucccggagcacaaucggcgugaagauucauaaccuggacgaguucaaaaucauuaaugaaucuaucaccgggcuuuacagcaacgaggugaccaucgucuga

SEQ ID NO: 4446 - RNA, 4200 nt, Artificial Sequence
  Cas9 variant
augaagaccauccugggccucgaccuggggacaacgagcauuggaugggcccuugugaaagaggcugaacccuucuccgaugagaagucugaaaucgucagacugggcguucgggugauuccucucaccguggacgagcgcaccagcuuugaaaacgggaaauccaucacaacaaaugcccugagaacccagaagcggggaaugcgcagaaaccuucaacgguacaaacugcgcagacaggcgcucauugaggagcugaagucuacaggcuggaucgggaaugauuucaucuuuagcgaaaccggaccgggcuccacguuccggacccugcgccucagagcuaagucugccagcgaggaagucacacugggcgaccuugcccggauucugcuccagaucaacaaaaagcgcggguauaaauccagcagaaagauggugucuuccgaugacggacaggcuauugauggcauggccguugcuaaagagauguacgacaaggggcugacccccggagaguauguguaccaacggaugcuugaaggcaaguaugccaucccugaguuuuacaaaagcgaucugcaggaagaguucgaccgcauuugggcgcuccagaagucuuuucacaucgaacugacagaugagcuguauagaaaacucuccgaccggaauaagagccagaccugggccauuugcagagaugagcuggggauccaaggacuuaaaucuuccuucaucggcaaggaacgccugaaagaggcuuaccgguacagacaucucgccgcuacgcaggaagucaacauggaggugcugacaugugcccuucaggaaauuaauggccagaaggcgagccuguccgggcuccugucuaagaucagcgaccgcuccaaagagcuguaucucaacaaucugaccguuggacaaaugcuucugaagcggauugaggacaaccccaauaacagccucaaaaauaucguguuuuacagacaggauuaucuggacgaauuugagcgcauuuggacaguccagucuaaguaccacaccgaacuuacccaugagcugaaaaagcggcucagagauaucaucauuuucuaucaacgcccucugaagucccagaaaggccugaucagccucugcgaacuggagacaaaggacauugagguggccaucgauggggugaaaaagaugaaaaacauuggaccccgggucuguccuagaucuagcccgcuuuuccaggaauuuaagaucuggcagacgaucaauaacauuuucguuaacggcgcugcccuggacgaugaggacaaguccgugaucgcuaaagaacucauguucaaggauaaacugaaggacucugaucugcuuaaacuccuguuuaagaccacaaaggggcaaagcgugaauuucaaagaggucgacggaaaccgcaccauggccacacugaugaaggccugcuuuaaaauugcugagaaucucggcuacgacgauaucggccuguccaaacuuagcucugaagaccagauggugcggauugaggggaucuucaaggaacagggauuuaagaccggcuuccugcacuuugauuccagccucgcgucucccgaguucgaaaaccaggacuccuauagacuguggcaucugcuuuacagcuacgagggggauaaauccgccucuggaaaugagagccucguuaaguguauuauggaccugugcuccauggaugaaggcucugcuaagauccuggccagcuguacguuucucccugacuaugggucccugagcgccaaagcuaugcggaagauccuucccuacaugaaagauggccuggaguauacagccgcgugcgcuauggccggauaccgccacucuaagagaucccucaccaaagaggaacuggacaccaaggaauauagcgaucggcugucucuucucccuaagaacucccugagaaaucccguggucgagaaaauucugaaccaaaugaucaaugugguuaacagcgugauugacgucuacggcaagccggaugagauccgcauugaaauggcccgggagcucaaaaagucugcuaaagaaagagaggaagcccagcgcgacaucgcuagcuccacagccgagagccagaaggugaucgagauucugaagggggaaccuuucuuucuucaguuccccaccagaaaugacaucauucgguaucgccuguaccaagagcucgcgcagaacggauuuaaaacacuguacucuaauacguauaucccuaaggauaaacuguucuccaaggaauuugacauugagcacaucaucccccaggcccuuauuuuuaacgauagcuucgcuaauaaaacccucgaguccagacaguguaaccuggaaaagggcaaggagacagccauggacuacgucaaaucuaaguaugaugaaaccggggugcaaacauacugcgaccggguuaacggacugaucggcaaagggauuagcaagaccaaagcuaaguggcuccugauggagggcaaagauauccccgaagacuuuauuaaucgcgagcuuagagauucccaguauaucgccaagaaggcgcgggagauccuggaaucucucgugaaauucgucgugccuacgaccggaagcguuacagcccgccugagagaggacuggcagcuggugaacgucaugcaagaacuuaauugggagaaguacgcucggcugggccucaccggggugcgcgaagauaaagacggaagacggauuccguuuauccaggauuggacaaagagaaacgaccaucgccaccaugccauggacgcucugaccauugccuucacgcggagacaguuuauccaguaucucaaucaccugaacuccaaaauugaugugguuucuugggacaagaaggaucuugaccugcgcgauuacgaccucgaggauaucaaauucggcaaucugagcgccggggaccgguacggaauugucaaggcucugcaagauaaauuucuuuauaaggacggcaacgauaaauacagauucgugcccccuaucccccuggacgaguuucgccggcaggcgaaggaacagcucuccgacauccugauuagcuucaaggccaaaaauaagguguguacaagaaacgucaaugugaccaaaaacaagggcggcgcuaaucgcaaagcccagcucacaccucggggaccccugcacaacgagaccaucuaugggucuucccuugaauacguuaccaaggagaaugaaaagauugggagcucuuuugauacagagagaaucacgaccgugugcaaaaagaaauuccgggacgcccuggcucgcagacucgaggaguucggaggcgauccgaagaaagccuuuacagggaagaacuccccugaaaagaaccccauuugggucgacgaacaucacagcgagcaagugccugcgaaaguucggaccgugacaaugggacagcgcuucaccggcagaaagcccaucgaugcuacgcugaaaaucgagaaggucauugacaaacggaucagagaaauucugcaggcccgccuugaugaguuugacgggaaggccgcuaaagccuucucuaaucuggaugaaaacccuaucuggcucaauaaggagaagggcauugcgaucaaacgggugacaguuuccggacccgcuaacccggugccugucagauuuaagcgcgacaaagauggcaagcccaucauugacgaugccgggaaaaccaucggagccgacuucgugacccccggcaauaaccaucacauugcuaucuuucgggacagcuccgggaagcugcaggaacauccugugagcuuccucgaggccacaauugcuaagucucacggacuggaugucaucgacagaaauuauaacaaagaugagggcugggaauuucuuuucacccugaagcaaaaugaguacuuuguuuucccgaacagcgaaacaggcuucaauccccuggacuaugaucucacggacccucgcaacuacgccgagauuucccccaaucuguaccgggugcagucuaucagcaccaacgauuauuucuucagacaccaucuugaaacaaccuccgagaaaaauaacucucuguacgggaucacauggaagcgcauuagaaacgcgagcgcccucgagggacuggugaaaguccggaucgacaaucucggccgcauuguggcuguuggggaauaugauuga

SEQ ID NO: 4447 - RNA, 4200 nt, Artificial Sequence
  Cas9 variant
auggagacccaggccacagcucaacugaucagcggccaccucaagggguaccccauuuaugacuacuucgugggacuggauaucggcacgaacuccgucgggugggccguuaccaauagaauuuaugaacuucugaaauuucggucucauaagauguggggaagccgccucuucgaggaaggccagacagcgguggugagacggggguuucgcuccaucagacggcgccuggagagacggcgccuuagacugaaacuccuggaagcucuguucgccgacgccauggcucgggucgauucuaccuuuuucauucgccucagagagagcaaguaccacuaugaggacaaaacaaccggacauaaguccaagcacauccuguuuaucgaugacaacuacacagaucaggacuauuucgccgaauacccuaccauuuaccaucuucgggcugaucugauggagaauggcacgucugacauccgcaaacucuuucuggccgugcaccacauucuuaaguauagaggcaacuuccuguacgaaggggcgaccuuugauagcaauuccagccucgacacaguucugaaacgggcccuggagcagaucgaguuccauauuuuuaacgcuaccucugaagaugcccuccacuccauccuggacauugugaaacuucaagacaagacaaagagcgauaaggcuaaagccaucgagucucuggucgacaccuauaucacggauaagguggaauccagcugcacagacaaagagaagaaagaucuccugaaggcggacaaaaagagacuucgcgccuucgcuaaucugauucucggacugaacgccaaucugaccgaucucuucggcacaaucgaagagauugaggaagacuuuguuaagcugcagaucaccggggauaccuacgaggaaaaacgggacgauuaugcuaagguguggggagacacaauuagaaucaucgacgauuguaaaucugucuacgacuccauuauccuuaugagcauuaaggagccgggccugacgaucucccagucuaaagugaaggccuucaacaagcauaaagaagaucucgccauucugaagcgccuucugaaaagcgacaaguauaucuacaaaaauauguuuaaggcugaugagaaggggcucgcgaacuacgugcacuauaucaaacagggacggaagaaugagaccggcugcuccugugaagacuucuacaaauauacaaagaaagucguugagagccugcccgauucuuccgacaaggccuacauucugaacgaaaucgagcuccaaaagcugcuuccucugcagagaauuaaagauaauggcgugauccccuaucagcuccaccuggaagaacugaaggcuauucuugagaaaugcaaggacaccuuuccuuuccucaacacagugagcgauggguuuaccgucgccgaaaaacugaucaagaugcuggaguuccgcauucccuacuaugugggaccucucaacccgucucauagcaucgacaaaggcggguuugccuggguugaacggaaggagcccggacaggugacgccuuggaauuucgaggauaagaucgacagagaaaaauccgcugaggccuuuauuaagaaccugacaaauaaauguaccuaccuuaucggcgaagacguccugcccaagucuagccuccuguacuccgaguucaugcugcuuaacgaacucaauaaccugcgcauugaugggaaaccucuggagcaagcggugaagaugcaccucaucgacgcuguuuuuaagaaagagcauaagaaacagaccaagaaucggauuaucgaguuccugaaagauaacaauuauauccuuggaaagcacaagcccgagguggacggccuggaugaaagcauuaaaggcgaccucgccucuuacagagauaugaagcgcauccugggggacgauuucgacgucuccauggccgagagcauuaucacaucuauuaccaucuuuggagaauccaaaaacaugcugcgggagacacuuagaaagaaauucggcagcauccucuccgaggaucagauucggucucuggcuaagcugcgcuauagagacugggggcggcucagcaagaaauuucugaucggaauugauggcugcgugaagggggaagacggcacgccgggaaccaucauugacaugaugagaaauacaucccauaaccuuauggagcugcucggcgauaccuucucuuuuauggacgucaucaucgaagagaaugauaaacugacaaaggggcaagugguugacccucacgaaauuaucgaggagcugggacuuagccccgccgugaaacgcgcugucuggcaggcccuccggauuguggaugaaguuauccacauuaagaaagcgcugccuuccagaaucuucguggaggucgcccgcaccaacaaggacgaaaagaaaaagaaagauagcagaaagaaacggcugcaggagcucuacaagucuauucagaaggagucccccgaauggcugagcgugacgcgcgacgagucugauaaacuuaucuccaaucuggacagagcugaugacagcucucuccggagcaagaaacuguaucuguacuauacccaaaugggccgcuguauguacuccgggagagugaucgaccuugaucagcugaacacagacaaguacgauauugaccauaucuauccccggagccucaccaaagaugacucuuuugauaaccugguucucugcgaacgccaggagaaugccaagaaguccgacaacuacccuauugauccggacauccagaaugcuagaaaacccuucuggacauuucugaaggaucaaaaccuuauuagcucccggaaauaugaacgccugaccagaguccucccucuggaggccgacgaucugacgggauucaucgcgcggcagcuuguggagacaaaucagucugugaaggccgucaccacacugcucagacgccuguaccccggcguggacguuguguuugucaaagcugaaaacgugaccgacuuccggcacgauaaugacuuuaucaagguuagaagccucaaccaucaccaccaugccaaggaugcuuaucugaauauuguggucgggaacguguaccacgagaaauucacccgcaauuuccggaaguuucuuaaaaagaacggcgccaaaagaacauauaaucuggcccgcauguucgacuuugauguuauguccacgaacgcuaaggacggaaaggcgugggauaucaaaaccucuaugaauauugugaagaaaaugauggccagcaacgacguccgggugacaaagagacucauggaacagaaaggcgcucuguccgaugccaccguguacaaggccucugucgcugggaaagccaagggaggcgcguacaucgggaugaagacaaaagacagcguuuucuccgaugugagcaaguauggaggccgcaccucuauuaaaaacgcuuacuccaucguggucgaguauacggggaagaaaaaugaaaucauuaaggagaucgugccucugcccguuuaccuuauuaaccggaauaagacagaccaagagcugauccauuauauugugagcaucauuccgcaggccaaaaacgucucuaucaucuacaagaaacucuguauuaaucagcuggugaagguuaacggcuuuuauuacuaccucggaggcaaaaccaauaacuauuucuggaucgauuccgccauucagguggucaucgcugacgaauggauuccuuaccugaaggugcuugagaaguuugacguuaugagaaaacaaaauaaggaacugaaaguggggaccgucagcacaucuauccagaaccagggaaagaaaguggugaucaagauucuggaggaacggaaugucgaguucuuuuccuaucucguuggcaagcugcacagcuccaucuacagcaaaaugaaggggaacaaagccggagagcuugcgaccaagucucuggaaauuuucgugaauaugagccucgagaaccaaugcaucuaucugauggaacuccugaaucuucugacaaacaaaaaggcucccgaugugaaaccucugggcauuacggccucccgcgggaccaucggcucuaaggucagcaaccaggacgaguuuaagaucauuaaugaguccaucacaggacucuacucuaacgaagugaccauuguuuga

SEQ ID NO: 4448 - RNA, 4200 nt, Artificial Sequence
  Cas9 variant
augaaccugagaaauaccacagacgaguacaacaucggccucgauauggggacgaauagcgugggaugggccgucaccgacaaggcuggcgccauugcgcacuucaaggggaagcccacacugggaucccggcuuuuugaugcugcccagaccgccgcuggcgcccgcauccauagaucucaacggcgcagauauguucggcgcagauggcggcuggaccuccugcagagccuuuuccaggaugaaguguccaaaguggacucugaguuuuucugccgccugagacagagccggcucuacgucggggaucgcgaaaagggacacgcugacuauacauggccuauuuuuaacgauuccgacuucaaugagguggauuacuauaaaagauuuccgaccaucuaccaucugcggaaguggcugauggaaacagacgagaaggccgauauucgccucaucuaucuggcgacccacaacaucguuaaacauagaggcaauuuccuucgggagaacaauaagucucugagcuccagagacgccaaccccgcucaagccgugaaaagccuccgccuggcucuuaaugacugguguucugaacgggauuacgagugcgccuggaagggcgaagaggacgauggggcgauugacgaggccauccugaacguccucgcugauggagaaaaaggcagauccgaccaggccaaggagauugcuaagcugacggggguggauuguggagacgccaaacagagcaagcagugcaaugaagccaucgcuaaagcgauuguuggccugaagguggagaugaaaaacaucuuuggggaguucccugccgaaaagaccucuuacauuuaucucuccagcgaugaggacgucgaagcugugcgcgagucuugucccgaugacuccggagaacuguuucaagcccuuugcaaacuguacagcgccuauauccuccaggagcugcuuuccuacgcugacccuucuggccagacaaucagcgccaauaugguggcgaaguauaagcaguacggccgggaucugagacuccugaaagaacugacccgcacauaugcuccccaaaaguacgaccucuucuuuagaggggagaccuacgccggauccagcgauuaugucguugacgaggccagaggcuacacgcgcuauaaccuggggacaaccaaagcuaacuacgaugacuuccagaagucugugaaagaacuuuucaagggaacagaugcccugcaggacgagcgguaucaagaaaugaugguggcuuuuggcgagcagaaguuccucagacgccugaaaaccuccgauaaugggagcauuuacuaucagcuucaccuggaggaacuccacaccauccuggagaaccagggaaagcauuacccuuuucugcucucugaagaggacaaaauugaaagccuggucuccuuccggaucccguacuaugugggcccccuuacaagaaagaaugccgcgauuggccacgaugggaaagagcgguuugccuggucuagccgcaaggacggaauggagcaugcuguuaucacgccuuggaacugggaagagaucauugauagagacaaguccgccgaagacuucaucaugcggaugaccggcgauuguacauaccugcaaggggagcccgugcucccuaaaugcagccugcuguaugaagaguuuugugcucuuaaugaguucaacggagcccacuggaccgucgacggcgaugacgaaagacgcuuugaugcggcccagcgggagagaauuaugugcgaccucuuccgcagaacacggucugugaccuacaauaagguuuccgauuggcuggaacgcaaauauaacuuuacgggggcuagagugcggggcggacagggcgagcacggguucgaaagcaagcugggaucuuacaucuuuuucuguaaagacgucuucaagacagauggccucgacgaggccgauuauaccaugauugagcagaucauccugugguccacccuuuuugaagaccgcgauauucugaagagaaaaaucgaggaggcuuacgggggagaccggcucacaagcgaacaaauuaaggugaucugcaaaaagcgcuucaccggcugggggagacuguccaaacggcugcuuacagacauuaaggucaauacggauaccggccgcaaaucuaucauggacgugcucagagaaggaaaccccaauaacggccagcggagcagaacaaugguuuuuauggaggugcugcgcgaugaggaccugggguuccagaaggccauugauggacucaaucgggacuacuuuagagaacauaacaauggccugauggaugucaacgaccuuccgggguccccugccauccgccggucuaucaaccaggcugugagaauuguugaugagaucgcgagcauugcccgcaaggaacccaccaauaucuucauugaggugacacgggaggaagacgauccucggaaaaagggaaaacgcaccaagcggagauaugacgcuaucaaauccgcccuggagaaguuuaagaaagacgaucccagccucuggaaggaacugugcgagaaagcccccggcgacauggaugaacggcugucucuuuacuucaugcaacgcgggaaguguauguauuccggcagaccuaucaaaauugaggagcuccacacgggaaaguacgaagucgaccauaucauuccgcggagcuauaucaaggaugacucuuuugagaacaaagugcugguguaccgcgaagagaaucagcacaagaccgaugcucugcucauugacuccagcaucagacagaaaaugggcggguauuggcggaugcugcaugaugccaaacuuguuggagacaaaaaguucagaaaccuguuucgcaaucacaucgaugacaaggcgaugaaaggcuucgucgcucggcagauuguggaaacaucucaaauggugaagcucguccagacccuguuugaggccagauaccccaacacacgcaucgugccuguuaaagccgggauuagccacgaucugcgggaggcugccggacuugugaagugcagagaagcgaaugacuuccaucacgcucaugacgccuuccucgccugucgcaucggccuguuuauucagaaacggcaccccuccgucuacgauaacccuaucgggcuggcuagaaucaugcgcgacuaugccagaaugcaagcucgggaguacaagaaaagccacugccucgcccauacccagggcuucauuguuaauucuuuucuguccagcggauucgaugaagagacgggcgaaaucuuuaaggacgauugggacgcgaaggccgagguggaggggauucgcagagugcuuaacugucggcagugcuucaucucccgcaugcccgucgaaggagauacaagauauggcgggcgguacuggggagagaccauuuauucuccgaaaggcaagcacaaacaugaaaucccucugaagcagggccucgaccccaaucuguacgggggauauagcgaucugcuuuacuccuacuuucugauuuaugaggcuucugacgugagcuccggcgagagaguucuccgcuucaucgggaucccuacaucuauugccgcucggauggccaaccaaaagagacuggaagaguacgugagccgccucgcccugcaggaaaaucuugagcacguccggauggugagaaagaucaugaagaaacagcugauugaaguggauaacugucggcuccuggucaccgcugcggacgccguuaccaaugcuacagagcuggccuuuucccuugaugagaugaagaucauuagcacgugcgccaaauguaucaacggagcugaccccucugccaucgacaagauuggcaacgcgcaggauuccuucuuugacaaucugaaacgcagagggagcgaucggugcgcucuccuguucucucaacucaagcuggacaaacuuucccagaacuucuauaugaucagcucugaugacaaguccaagauucugaucagcauucucgaucgcaucagagccaaauccaauagcguggaccugucucuggugggaggcgccaagcaugcugcccagaugaaauuugauuucaacgcgaaacuuaauaacccugcuagcuccuuuguccugaucgaccagucugugaccggcauguucgaacggcgcacaagaauugggcucuga

SEQ ID NO: 4449 - RNA, 4203 nt, Artificial Sequence
  Cas9 variant
augaaccugagaaaugccaccggcgacuacagcaucgggcucgaucugggaacaaacuccgugggcugggcugucacggacucuaaugggagcauggcccacuucaagggaaaacccacccuuggcucccggcuguuugaugcggcugagacagccgccggggcucgccagcauagaggacaacggcgcagauauguucggcgcagauggcggcucgaccugcuucagggccuguuccaggaugaagugaacaagguggacucugaguuuuucauucgccucagacagagccggcugcacgucgaagaucgcgccgagggccaugcuggguacagauggccucuguuuaaugacaccgauuucacagaaaaagacuauuacaagcgguuuccgaccaucuaucaccuccgcaaauggcugauggagacagaugagaaggccgacauuagacuuaucuaccuggcggcccauaacauugugaagcaccggggaaauuuccucagagaagauaacaaaaaucuguccucucacaacgcuaaucccgccgaggcuguucgcagccuucggcaagcccuggacgacuggugcgcggaaagaggcuaugugugugccuggaccuccgucgaugaccucgcugaggccgauagccauauccuggacauccugacgaacucuaaggagcgccgggcugaucaggccaaagaacucgccaagcuguuugggguggacugcggagauaccaaacaguccaagagcuguaauucugcucuugcgaaggccguugugggccugaaaacagagcucaaggacgucuucggggaauuuugcgcugagaaaaccgccauucaccuguccagcgaugacgauguggaagccaucagagacgcuauuccugacgauucuggagagcuuuuccaggugcugugugccgucuacuccgcguacguucuccaagagcugcugagcuaugcucccggccagacaaucuccgccaacaugguggccaaguacgaccaguauggcaaagaucucaagcugcuuaaaaaucuggcucgcaccuacgugucucgggaaaacuaugacgccuuuuucagagggcagacguacgaggauagcaacgacuauaaugucgauaaggcucaaggauacacacgcuacaaccucggcaccacaaaggccuccuaugacgauuucaaaaagagcguggaaaaacuguuuaaggggacccaggcggagcaggacaaacgguaccaaggaaugaugaagagauucgccgaagagaaguuucuucgccggcugaaaaccucugauaauggcuccauuuauuaccagcuccaucuggaggaacugagagcuauccucaagaaccaggggaaacaccacccuuuccugcuugaggaagagaagaaaauugaaagccugguuucuuuucggauccccuauuacgugggaccucucagcuccaagaaugccucucuggaccauaagggcaaacagcgcuucgcuuggagcgagagacggccgggcaugaaggauacagucaucacgcccuggaacugggaccaaauuaucgacugcgaucaguccgccgagaaauuuauucugagaaugaccggggacuguacauaucuucagggagaaccugugcuccccaagugcagccugcuguacgaggaauacuguguucucaaugagcugaacggcgcgcgcuggaccaucgauggggacgauuggcggagauucgacguggcccagcgcgagggcauucuucacgaucuguuuagaaaaacacggucugucgcuuauaauaagguggccgacuggcucgaacgcgaggaaaacugggcuaaugcccaugucagaggagggcaaggcgagaacuccuucgaaagcaagcugggaucuuacaucuuuuucugcaaagauguguuuaagaccgccgcucuggacgaggcggauuauccuaugaucgagcagauuauccuuuggaauacacucuucgaagaccgggccauucugaaacgcaagaucgagcaggcuuacggcgaacaccaugggggaaaacugacggaugagcagauuaagguuaucuguaaaaagagauucaccggcugggggcggcucucccgcaagcugcuuaccggaaucaaaguggacgccgacacaggcagagucagcauuauggaugugcugcgggaagggaaccccaaugagggccaacgcuccagaaccaugguucucauggaggugcugcgggacgaagaucugggauuucagaagaaaaucgacgauuucaacaaggccuauuuugcuggccagggggagggacuuaugucugucaacgaccucccgggcagcccugccauuagacgcuccaucaaucaggcgauucggaucguggaugaaauugcuucuaucgccgggaaagcccccagcaacguguucaucgagguuacaagagaagaggacgauccucgcaagaagggacggagaacgaaucgccgguacgaggacauuaaaaacgcucuggaaaauuuuaagaccgaggaucaagaacugugguccgagcuccugggcaaagcccccaacgaccuugacgagagacugagccucuauuucaugcagcgcgggaagugcauguacucuggccggcccaucaaacuggaagaacugcacacaggaaaguacgaagucgaucacauuaucccuagauccuauauuaaggacgauagcuuugagaauaaagugcuugugugccgggaagagaaccagcgcaagaccaaugagaugcucaucgacccggcgaucagacggcgcaugggcgauuacuggagaaugcugcauaaagcuaagcugauuggggacaaaaaguucaacaaucucuuuaugcgggauagaaucgacgauaagacacugaaaggauucgucgcccgccaacuuguggaaaccucucaguccguuaagcuggugcagacgcuccuggagguccgguaucccaacaccaaaauugugccuguuaaggccaauaucagccacgaccugagagaagcugccgaucuugugaaaugucgcgaggcuaacgacuuucaucacgcccacgaugcguaccuggccugccgggucggccucuucauucagaagagacaucccucuguguaugcuaauccuaucgggcugagccgcguuaugcgggacuacgccagaaaacaagcuggagaauuuaacaagacacacuccauggcccauaccaagggcuucaucgugaacagcuucaugacaucugaguuugacaaagagaccggggaaauuuucugggaugccgaggcugcggucgaagacauccgcagagugcucaauuaucggcaguguuuuauuucccgcaugcccguggaggauacgggcgccuucugggaccagacaaucuacagcccgagauccaacaagcggcuggaacuuccucugaaagaugaccucgaucccaauaaguacggaucuuauagccgcgagcaguuugcuuacuucuuuauuuaugaggccagagacgccaaaaaguccaagaccguccugcgguucgcucaaguuccugugagagugacaucugccaucgcgcgcgauagcuccaaacuggacgaauacgcuucuggccuugccguccaggaggggcuggaauuuaccaagaucauucggagacgcauccucaaaaagcagcugcucgagcugaacggagaucggcuugugauuaccggcgccaaagagguuagaaaugcuacagaguucgccuuuacgcuggaggaaaccgcgcucguggcuaugugcagcgagaucgcccgggaagggguccccuccgagauugccagcgacgugcagucuaucuccagccaacugucugaucuguuccuugcucugauugagcgcggacucacaaucggcguuagacugcacggccagcucaagcuggggcaguaucuucggcaauucgaagacgccgcucugcgcgacaaggccaaagugaucauuggaaucauuuccaucaccaacggcgcgacaaauacccuggaucucagcucucugaacggguccaagaaugucggacaggugagaauuacgcauaacaaacuucugaaugacaagagcacauccuacguucucaucgaucagagcgugaccggcauguuugagcggcgcaccagaaucgggcuguga

SEQ ID NO: 4450 - RNA, 4203 nt, Artificial Sequence
  Cas9 variant
augaagaccaucacagaggacuacauucugggccucgauaucgggacgaacagcugcggaugggccgugauggacaaaaagaauagacugcuucggcugcgcggcaaaagagcuauugggucccaccucuucgaagagggacauucugccgcggaucggcgcagcuuuagaaccacacggcgcagacugaagcggcgcaaauggagacuucggcugcucgaagaguucuuugcugaacccauggccaaggucgacccugccuucuuuguucgccugcaccaguccugggugucuccgcuggauaaggacagaaagaaguaucaugcuaucguguuccccaccgccaaagaggaucacgaguuuuaccaugacuauccuacaauuuaccaccuccgggaugcucugaugcgcgaagacagacaauucgaucuucgggagaucuuucuggccauccaccauauugucaaguauagaggcaacuuccuccaggacacccccgugaauagcuuuguugcguccaaaaucgauguggccucuuuccugacaaacgucaaucaggcuuacgccgacaaguauggggaggagcagaacuuuauugagcuuaaugaaaacaaugcugccgcgaucgaggccgugauucgcggaaaggacaaagauaagaccacgaaacaacuggacaaggcuaaaaagaucaccaaacuccugcagagcuccacaaacaaguacgaaaagaauguuacccggcagauugccaacgcuaucaucggcuacaaaacacaguucgagaccauucugggcaaggauaucgacaaaaaugauaaggccgacugggaguucaaacucagcgauggggacgccgaugacaagcuggagaaccuucugccugaguuugaugacaaugaccaauauauuguggcugaaaucaagaaacucuucggaucuauugcgcugucccagaucgucuacgagaacaugacgcuuagccagucuaugaaguguaaauauaaggaucacggcgaagacuacgaucugcucaaacaguauaucgccacacuguccgaccauagccaagugagaaagcugcuccuggcuuacgaucuuuaugugaacaaucgccacgggcggcugcucgaggccaagaaagaauuuaagcaggacaaagcccugacccaggaugaguucuacaagauugucaaagagaaccuugacgauucucaacuggcucagaagauccuccagaagauugacgaaggaaaauuuaugcccaagcagagaguuaauaaaaacggcuacaucccuuaucaacugcaccagauugagcuggaucagaucaucgccaaucaguccaaguacuauccguuccucgcggaagagaaccccgugaaagaacaucgcaagcaagcuccuuacaaacuggacgagcuugugcgguuuagaguccccuauuacguggggccucugauuagccccgaugacaagcgcaaggacgagcagcagaauaaaaaccacgaaauguucaaguuugccuggaugaaacggaaggaugacaauggagccaucacaccguggaacuucgcucagaaaguugauagagagaccuccgccaaucgcuuuauuaagcggaugaccgugaaggacacauaucucaucggcgaagauguccugccugcuagaucucugcuuuaccaaaaauucgaggugcucaacgagcugaauaacauucggguuaauggcaagcgccuggaacccaaauuuaagcagaaaguguucaacgaacucuucaagcagaagaacaaagucacgaagaaagccuuuaaggaguucauccugcagaauaccgggaugaaaacagcggaaauugacggacuugccgauccuaccaaguuuaacagcucccugagcucuuacuaucaucucaaguccacaaaaguguucgacaagcaacuggaugacccccaguaccaggcugauuuugaaaagaucaucgaguauagcucuauuuucgaggacgccgaaaucuaccaagagaagcugcacaaagaaauuaaguggcuuacccccgcucaguuuaaagccaucgcgaauuggagacuccagggcugggggcggcugagcagaaagcugcucgucgagcugaagggaaaaggcggggaaaacauuaucuaucagcuuuggacgacacaaaagaauuucaugcagaucgugaacgagccugagcugaaaaaggccauuguuaaagaaaaucaucaggcuaccgaggaaaagggaaucgagaagauucucgaugacuccuuuaccucuccggccaacaaaaaggcuauccgccaggugauuaaagucguggacgauguugugaaggccgccggcggcaaaaagcccgcucaauucgcgaucgaauuuacacgggagccuaaguggaauccccaccugagcaacaucagagggaccaaacugcuucaggucuacgaggacacagccaagaaacucguggaucagucccugacggacagccugcgcgaaaauaugaccaacagaaaucuccugaaggaugaguauuuccuuuacuuuauucagggaggccgggacgcuuacacagggaaaaagaucgauauugacgauaucccuaagaaauaucaaauugaccacauccugccccagucuuucaucaccgaugacucccucgacaaccgcgugcugacagaaauugagaucaaucagaagaaaggaaagaaauacgccagccaucuguucgccccgaagccugcuuuuggccuuaaccaaucuauuuccgagauguggaagaccuggcagaaagccgggcucaucagccagagaaagcugaacaaucuccuguucgaucccgaccugguuaaagauaagcagaaaaagggcuuuauuaaccggcaacuugucgaaacgucccagaucauuaaacuggugucuaucauccuccaggacaaguucccugauaccgagauuaucacagugaaggcgggauauaauaccgcucugcgcaaagaacugaaacuuuacaaaagcagagaggccaacgacuaucaccaugccauugaugcuuaccugacagccaucugcgacaauuuucucuaucaggucuaccccaacuuccggccguuuuucguguacggccaauuuaagaaauucucccaggauaccgacaagcagaagaaagcgguuaaguauuacgggcugaaaaauuuucuccugccccuucuggaugacucuacgggagaugaagugauggucaaccacacaaagcacgugguuuuccauaaacagcgcgacauuuucaauagacucauccaggcuuauaacuacaaguauaugcuggugagccgggagaccacaaccgaaaauuccaacauguuuaauaugaccaucuacccgcgcggcgaaagagaccggaagaaaacaagaaagcugauuccuaaagggaaggaucuugaccccgccaucuauggaggcuacagcgggaacacggaugccuacauggucauugugaaaaucgagaagaccaaggaaacacuguauaaaguugugggcguccccaugcgcgcucucgccucucugaagaaagcucaaaaggagggaaauuacgaccaggaacucaacaaagugcuggagccucuuauuauguucaacaagaauggcaaauccaaggccgggaucaagggauuuaccguggucaaagaucacguucauuucaaacagguggugaucgacggcgauagcaaauuuaugcuguauucugcgcaauaccgggccaacgcuaagcagcucacacugucccaggagaccaugaaagucgugacggacaauacagaugacauggaucaaaagaacgccgacaaggaucagcugcuucugaaugcuuaugacgaaauucucgagaaaguugaccaguaccugccucucuucgauaucaacggguuuagacagggacugcacgacggccgcgccaaguucgccgcucuuaaaaccagcgaaaagaaauauacccugaagaaugugcugaacgggcuccaugauaaucuggucacacccaaccuuaagaauauuggcaucaaaaccccuuuuggacugaugcaaucuagcuccggcauuacacucagccccaacgcgaagcugguguuccagucuccuacggggcucuuugagaaacggguuaagcugaccaaucuuuga

SEQ ID NO: 4451 - RNA, 4203 nt, Artificial Sequence
  Cas9 variant
augggcaagcagaaauucaacgacuacuaucugggguuugauaucggaaccaauagcgccggcugggcugugacagaccuccaauacaagcugcuuagauucaacaaaaaggauaugugggggucccggcuguuugacgaggcccagacgucuaaagaacgcagagucuaucggaauagccgcagacggcucgaucgcagaaagaagcggcugaaacuucuggaggaacucuuccuggacgagauuuccaagaucgauaacaccuuuuucaaacgccugaaggaaucuaaucucuacaacgaggacaaaagcauuaaguuuaauuauccccuguucaacgauaaggacuacacagauaucgacuuuuauaaugaguacaaaaccauuuaccaccuuagaaaggaucugaucuucgaagacaaaaaguuugacauccggcucguuuucauugcgcugcaucacauccuuaaauaucgcggacauuuuauuuucgagggccaguccuucgaagagaucaagucuuuugauagcauuuucacacagcuguccagcuacuuucucgagaacuucgacuuuaauaucgaugugucuauuaaagaaaagcuggaggaaaucauccuguccgacaacaccaagagcauuaaaaagacagaguucaaaaagaucuuuucugauaauaaagugcucuccguccugaacauggcuauugggagcaaggugucucuuaaggacguuuucaauaacgaggaacugaaagagcaaaagaucuccuuuagcgaaauugauuaugagaacgaaaagagagacgaguucuaccagcuccugggagaagauaucuuucuuaucgaccuggccaagaaaauuuaugauuucauggugcucaagaagauccugaaaaauaccgacuccuuuucugccagcaaggucgcucuguacugcgagcacaaaaaggaccucgaugaccugaaauauauuuucaagaaguaccuuacgaaagaggauuacuucaaguuuuuccgguccaacguggaaaagaucaauuauccuagcuacauuggccugaacaagaucaaaucuaagaaaaucauuaaggagaauaaguguuccaucagcgacauuaacaaagaacucaagaauaaauaucugaaggauaucaaacuugaggccaaggacaaggaacuguuuaaccgcauuuucaauaaacucgaugaguuuaaguuccuggagaaacugaagucuagcgaaaacuccaccguuccguaccaggugcaugagaucgaacucaaaaagauucuggacaaucagagaaaguauuaccccuuucuuaacgagaaaaucgauggcaagucugucuaugagaaaaucauucaacuguucgaauuuaagaucccuuacuacauugggccccucaauacagacccuaacgugaaaggaaagaauaccugggugguccggaaggaugagaacaacaaaacacccaucaccccuuggaauuucgaacagaagguugacaugcagaaaagcgcugaggaauuuauuaagagaaugacgaaccgcugcacauaucugaaagccgaggaugugaucgcgaaaaauucccugcuuuacgaggaguucauccuccugaacgaacugaauaaagugaccgucgacaacgaaauucuccacccgacacugaagaccgagaucauuaaugaacuuuuuaagaccacagugaaaguuacgaagaaaaaguucaucgaguuccugaaaaagaagcaggccgugaacgacgucgagagcauuaccggcaucgggguggaauuuaauuguaaacuccaaggauauaacacauuccggaagauccugggcaaaaagauugagaauguuaacgugaaaaauuuugucgaaaagugcaucgagcugaagugucuuuacgggucugauaaaaagcuguucgaaaacgcuauuggaaaaaucuauagagaguacaauauuaccgacgaggaauuuaacaagaucaaccgccucaauuucaacaaaugggcccggcuguccaagaaguuucucacagagaucagcuucgaaaagaccgauggcacgaagagauuugagucugugauugaggcucugcgcuccacaaauuauaaccuuauggaacugcucagcgacaaauucaaucugcaguccaagaucgaugagauuaacggcgaagacgauuuuucuaauaucgacauuaaagaguacgucgauaagcuguacgugagccccuccguuaagcggucuaucauucagaccuauaaaaucgccauggaaaucaagaaaauuaccaagaaagacccuaagaaaaucuucauugagauggcgaaggauaagggggagaaaggaaagacaaccgagaaaagaaaggacaaaaucaagaaacuuuacaaaaacauuaaggauacacucagcgacuauugcaauaaccugcaagaccugacgcuccagguggaaaaauacgaugacaaucgccugcggcagaagaaacuuuuccuguauuuuaugcagaugggcaaguccauguacaccgggagauguaucgaucucgaagaccuguucaacaauaacgucuaugauaucgaccacauuuacccccaaagcaaggugaaagaugacucuuuugauaauaucguucugguggagaaggaagagaaccaucgcaaauccaacgagcuucucaaggaagagauucagagccggaugaauaacuacuggaucuuccugagagaaaauaaauuuauuucuaaggagaaguauaaccggcugacacgcaaaaaggacuucaccgaugaggaacucggagacuuugucgccagacagcuggugacaacccggcaguccacgaaagagaucgcuaaguucuuugagaaaaucuucgaaaagaccacagugguuuacagcaaagccucucuugucagcgaauuuagagagaaguaugacauuaucaaggugcgcgaggugaaugaugcucaccaugcccaagacgccuaccugaacauugucgugggcaauguuuucaacaccaaauuuacaaagaauuauuggaaauucaccaaggauaucaaacggcagaacgaagagaauccuaacgaaaagaagggguacaaucucagaaaaauuuaugaguccgacguguucugcaacgauagcgucgcuuggguguacucuaaggaaaaucccaaauacaacacgaucaauacaguuaaggacaugguguaucgcaaaaccgcgaacauuacaagaaugcuggucgagggaaagggccagcuguuuaaccuuaccaucaaggauaaaacccagcugaagaaaaaugugggcaacaucguugccaauacaccgauuucccucaagaaccggaaacugcaccucaauagcguggagaucgcuaagaaguacggguauuucgacucccugaacaaugccuacuuuguccuuuucaaauaugaagagaagggaaaagaaaagauuggcuuugauucuaucacgauugccuacaaagagcgccugaagaaaaaccucgacaucgaaaaguuccuggagaauaagggguauaaaaacagcaagcugaucagaaaaauuuuuaagaaucaaaaagugcuuaucaacggauacccuuaccugcucaaguccuucaauaagcagucucagauuaaauuuaacaauuucaagauccuguaucucaacgagaacaaucugaaauuugcuaaggaugccauuaaauucgaaaagaacaaugcgaacguggaccuuaagaaacagaaguacaucgucagcuuucugaaaaagaaaaagcaaaaugagaucaacgaaaccuaugaggaauguauugaucggcucaaugacgaguucgacacacuguuccugaaacuuugcgauauccagaaauccucuauuuacaccaacuauaagcugcaggacuuuagcuccaauaaaaagagcaucgagauuaaagauaaguucgacaucuuuaagucucucgaucuguacaaaaaguccaaacucauuaaggaguuccugaacuauuacaaauacgaaaagaaugaccuugauuuuagccugaucgacaucgauaaaaaggcuaacuguauucaaaagcacuucacagaagaccugguuaaagauuuugugaucguggacgagucugucaccggccucuucgugaagaaagagcgccugaaguga

SEQ ID NO: 4452 - RNA, 4203 nt, Artificial Sequence
  Cas9 variant
augaagaccaucacagaggacuacauucugggccucgauaucgggacgaacagcugcggaugggccgugauggacaaaaagaauagacugcuucggcugcgcggcaaaagagcuauugggucccaccucuucgaagagggacauucugccgcggaucggcgcagcuuuagaaccacacggcgcagacugaagcggcgcaaauggagacuucggcugcucgaagagaucuucgcugaacccauggccaaggucgacccugccuuuuucguucgccugcaccaguccugggugucuccgcuggauaaggaccggaaaaaguaucaugcuauuguguuucccaccgccaaagaggaucacgaguucuaccaugacuauccuacaaucuaccaccuccgggaugcucugaugcgcgaagacagacaauuugaucuucgggagaucuuccuggccauucaccauaucgucaaguauagaggcaacuuucuccaggacacccccgugaauagcuucguugcguccaaaauugauguggccucuuuucugacaaacgucaaucaggcuuacgccgacaaguauggggaagaacagaacuucaucgagcuuaaugaaaacaaugcugccgcgauugaggccgugauccgcggaaaggacaaagauaagaccacgaaacaacuggacaaggcuaaaaagauuaccaaacuccugcagagcuccacaaacaaguacgaaaagaauguuacccggcagaucgccaacgcuaucauuggcuacaaaacacaguuugagaccauccugggcaaggauauugacaaaaaugauaaggccgacugggaauuuaaacucagcgauggggacgccgaugacaagcuggagaaccuucugccugaguucgaugacaaugaccaauauaucguggcugaaauuaagaaacucuuuggaucuaucgcgcugucccagaucgucuacgagaacaugacgcuuagccagucuaugaaguguaaauauaaggaucacggcgacgauuaccaucugcucaaacaguauauugccacacuguccgaccacgggcaagugagaaagcugcuccuggcuuacgaucuuuaugugaacaaucgccacggacggcugcucgaagccaagaaagaguucaagcaggacaaagcccugacccaggaugaauuuuacaagaucgucagagagaaccuugacaauagccaacuggcucagaaaauucuccagaagaucgaggaagagaaguucaugcccaaacagcgcguuaacaagaauggcuuuauuccuuaccaacugcaucagaucgaacuggaucagaucauugccaaccagucuaaauauuacccguuccucgcggaggaaaaucccgugaaggagcaccggaaacaagcuccuuauaagcuggacgagcuugugagauuucgcguccccuacuauguggggccucugaucucccccgaugacaaacggaaggauaagcagcagaacaaaaaucaugaaauguucaaguuugccuggaugaaaagaaaggacaacaauggagccauuacaccguggaacuucgcucagaaaguugaccgcgagaccagcgccaaucgguuuaucaagagaaugaccgugaaggauacauaccucauuggcgaagacguccugccugcucggucccugcuuuaucaaaaauucgaggugcucaacgagcugaauaacauccgcguuaacggcaagagacuggaacccaaauuuaagcagaaaguguucaaugagcuguucaagcagaagaacaaagucacgaagaaagccuuuaaggaguucauucugcagaauaccgggaugaaaacagcggagaucgauggacuugccgacccuaccaaguuuaacucuagccuguccagcuacuaccaccucaagucuacaaaaguguucgauaagcaacuggacgaucccgaauaucaggcugacuuugagaaaaucauugaguacuccagcaucuucgaagaugccgagauuuaucaggaaaagcugcauaaagagaucaaguggcuuauucccgcucaauuuaaagccaucgcgaauuggcggcuccagggcugggggagacugucucgcaagcugcucgucgaacugaagggaaaaggcggggagaacaucauuuaccagcuuuggaccacgcagaagaauuucaugcaaaucgugaacgagccugaacugaaaaaggccauuguuaaagagaaucaccaggcuacagaagagaagggaaucgaaaagauucucgacgauagcuuuaccuccccggccaacaaaaaggcuaucagacaggugaucaaagucguggacgauguugugaaggccgccggcggcaaaaagcccgcucaguucgcgauugaguuuaccagagagccuaaguggaauccccaacugucucacauccgcgggacaaaacugcuucaggucuaugaagacaccgccaagaaacucguggaccagagccugacagauucccugaaggagaacaugacgaauagaaaccuccugaaagacgaauacuuccuuuauuuuauucagugcggacgggaugcuuacaccggcaagaagaucgacauugccgauauccauaaaaaguaccaaaucgaccacauucugccucagagcuucaucacagaugacucucucgauaaucgcgugcugaccgagauugagaucaaccagaaaaagcauaaaaaguaugccucccaccuguucgcuacaaagcccgccuuugggcuuaaccaaagcauuucugaaauguggaaaaccuggcagaaggcgggacucaucucccagagaaaacugaauaaccuccucuucgacccggaucugguuaaggacaaacagaagaaaggcuuuauuaaucggcaacuugucgagacgagccagaucaucaagcugguguccauuauccuccaggacaaguucccugauaccgaaauuaucacagugaaagcuggguacaacaccgcccugcgcaaggagcugaaacuuuauaagucuagagaagccaaugacuaccaccaugcuauugaugccuaucugacagcgaucaacgacaauuuucucuaccaggucuaucccaacuuccggccuuucuucguguacggccaauuuaaaaaguucagccaggauaccgacaagcagaaagaggcuaucaaguacuauggacugaaaaauuuucucgagccccugcuugaugacuccacgggcgaugaaguuauggugaaccacacaaagcaugucguguuccacaaacagcgcgacauuuucaauagacugauccaagccuacaacuauaaguacaugcucguuucucgggagaccacaaccgaaaauagcaacauguuuaauaugaccauuuauccucgcggggagagagaucggaagaaaacaagaaagcugauccccaaaggaaaggaccuggauccggccauuuacggcggguauuccggaaacacggacgcuuacauggugaucgucaaaaucgaaaagaccaaggagacacuuuacaaagugguuggcgugccuaugcgcgcccuggcuagccucaagaaagcccagaaggaggggaacuaugaccaggaacugaauaaaguccucgagccccugauuauguucaacaagaauggcaaaucuaaggcgggaaucaagggcuuuaccguggugaaagaucauguccacuucaagcagguugugauugacggggauuccaaauuuaugcuuuacagcgcccaauaucgggcuaacgccaagcagcugacacucucucaggaaaccaugaaaguggucacggacaauacagaugacauggaucaaaagaacgcugacaaggaucagcugcugcuuaaugccuacgacgagauccuggaaaaaguggaucaguaucucccccuguucgacauuaacggauuuagacagggccuccacgaugggcgcgccaaguucgcugcgcugaaaaccuccgagaagaaauacacccuuaagaauauccugaacggacugcaugacaaucucguuacaccuaaccugaagaauauuggcaucaaaaccccguuugggcuuaugcaaagcucuagcggcaucacacugucccccaacgccaagcucguguuccagagcccuacgggacuguuugagaaacgggucaagcucaccaaucuguga

SEQ ID NO: 4453 - RNA, 4203 nt, Artificial Sequence
  Cas9 variant
augaagaccauccugggccucgaccuggggacaaacagcauuggaugggcccuugugaaagagacggaaaauuccaacgagaagucugaaaucauuaaacugggcgucagaguuaauccccucaccguggaugagaagacaaacuucgaagcugggcggccucugagcaccaaugccgaccgcacagcgaaaagauccgcucggcgcaaccuucagagauacaagcugcggcgcaagaaucucaucgaucugcugauuaaacacagacucaucgacaaggauaccccgcugacagagaucgggaaaaacaccacgcaucaaacccuugagcugcgggccaaggccgcucgcgaaagaauugagcucgaagaccuggcccggguguuucuugcuaucaauaaaaagcgcggcuauagaucuagccggaaggucaacaaugaggaggaaggacaggugguugauggaauggccguggcgaaaaagcuguacgacgagaaccucacacccggccaguaugccuacgaacugcuguccaaaggcaagaaauaugucccugauuucuaccgcucugaccuccaggcugaguuugauagcauuugggaauaucaaaagcaguucuacgccgacauccuggaugacgagcuuuacaaugcucugaaagggcagggacagcaaaacuccagaaagcgguuucucgccauuaagggcguguauaccgcggagaauaaagggaagagagacgaaguuaaacugcagcacuacaaguggcgcagcgaggccaucacacagaaacuuucuauugaagagguggcuuauguccugguggaaaucaacaacgaucucaauaaguccagcggauaccugggcgccaucucugaccgguccaaggagcuguauuucaacaaagagaccgugggggaaaaucucuggaagcagauucagaaaaacccccauacgagccugaagaaucaagucuuuuacagacaggauuaucuugacgaguucgaacaaaucugggagacacaggcucaguuucacccucagcugacccucgcccugaaagaacaaauucgcgauguugugaucuucuaccagcggaaacuuaagucucagaaaggacugcucuccuuuugccaguucgagagcugggagauugaaagaaaggacgagaacggcaaugugauccugaacaaaacaacccaacugcccaagcgccagaccgucggccggagaguggccccuaaauccucuccgcucuuucaggaguucaagaucuggcagaauauuaacaaucuggaaaucgcuaagauuagcgaugggaacuccaaaaauaagaaagagacagaagcgcuuagcgacgaugagcgcaagcuccuguucgaggaacugaaccugcggggaaaucuuucucaaaaagaaguucuccagauccugggccugaaggacaaagaguacaagacgaacuuucccgaggggcucgaaggaaacagaaccaaugccgcucuguucaacauuuaucagcagaucgccgagaaugaaggcuacggggauuggacaaagaaauccgcccaagagaucaaggaggaacuuaaagcuguguuuccucagauuggaauccaggccgacauucuggacuucaacgcggagcucgauggcaaggaauuugagaaucaagcuagcuaucagcuguggcaucugcuuuacucugccgaagaggacgauaaaaucaacgaagaggaccagauuaucuauggcaauagcgccgucucccucaagaagaaacugugugagaaguucggguuuacccccgaauacgcuaaauggauugccaacgugucucugcaggaugacuauggaaaucucagcacaaaggcuaugcgcaaaaucaucccuuaccugauugauggcaacgacuacuccgaggccugcgcgcuugccggguauaaucacagcaacucucugaccaaggaagagaaugauaaccgggagagacucaauaagcuggaacugcuucccaaaaacucccuccggaacccgguuguggagaagauccugaaucaaauggucaacguggucaaucaggugauugaaacguacggaaaaccugacgagguucgcaucgaacuggcuagagagcucaagaaaagcgccgaggaacgggcugagaugacaaagggcauuaacgaagccaccagacgcaaugaggauaucaagaaacugaucaccaagaacuucgggauucccaauccuaccaaaaacgacgugguccgguauagacuuugggaggaacuggcgccccucgccuacaaggauguguuuacaggccgccagaucaaaaaggaggaccuguucucuuccaaaauugacaucgaacacauuauccccaaggcucugcuuuuugaugacagcuucuccaauaagacacucgccuuuagagagacgaaccugaaaaaggcugaucggaccgccuauggauucaucgaaucugacuacaaugccacacuggaugacuauauucagcgcguugagacccucuacaacaaugcuaaaggcacaaucagcaaggggaaaagaaacaagcugcuuauggcgcaaaagaaucugccugauggauucauugaacgggaccuccgcaacucccaguacaucgccaaaaaggcuaaaucuaugauugagaagguguuuaacgaugucaaugugaccagcggcuccaucacggacagacugcgggaggauugggaccugaucaacgugaugaaagaacuuaauuucccgaaguauaaggcccuggggcucaccgagauugaggaacgcuacgauaucggacaggagaaaacaaagaaaguugaagucauuaccgacuggacaaagagaaacgaccaucggcaccaugccauggaugcucugaccguggccuuuacgacaaaaagccacgugcaguaucucaauaaccugaauaccauccacucucuuaagggcgacgaggucgaucuggaacucuccaagcuguacgggcugaaaaacacaauuaccgaggugguuaauaagaaacgcaaguucauucccccuaugcccaacuuuagagaagaggcgaaaaagcauaucgagaccauccuugugagcaucaagaauaaaaacaaggucuauacaaagaauauuaacaagacgaaaaaggaaucuggcuaccacaccaaagagcaacugacaccucggggacagcuccauaaggaaaccguguauggcaaguccaaaagacccaugaauaagccgacaaaaaucaacaagaauuucagccuggagcaggcucaacucauuaucaacguucaggaaaaagagcuggugcuucgccaccuggcccaguuugacaacaauccugccgucgcuuucgauaccaagacgcucaagaaaaugccccugcugaagaacggggagccucuuaaagaagugcuguguuuugaggaaauuuucacaauccggaaggacaucacccccgaucucaaaauugagaagguuguggacgaaaagaucaaagccauucuggagcagagaaagaaagauuuuggaggcaaugcgaaggaggcuuucucugaccucgauaaaaacccuaucuggcugaauaaggaaaaggggauuugcaucaaacgcgucaccaucacaggagugagcaacgccgaggcccuucaucaccaaaaggaccaccugggccgggaaauucuggacgauaaugggaaccccaucccggcugacuuuguguccaccggcaauaaccaucacgucgccauuuacgaggaugagaaaggaaagcuccaggaaaaaguugugagccuguacgaggcuguggccagagcgaaucagggccuuccugucguggacaaggggcugaacgaagaucucggauggaaauuccuguucacaaugaagcagaaugagauguuuguuuuccccaacgacgauuuugacgugaaugauaucgaccuccuggaugaaaacaacgccaagauuaucucucaacaucuuuuccgcguccagaaacuggcuacgaagaauuauauguuucggcaccaccuggagaccaacgugcaggagguuaaagaacucaaugacauugccuacaaguccaucagaagcacagagccccugaaaaacaucaagaaggugcgcauuaaucauaucggcaaaauuguccaggugggggaauauuga

SEQ ID NO: 4454 - RNA, 4209 nt, Artificial Sequence
  Cas9 variant
auggccaagaaagacuacaccaucggccuggauauugggacaaacagcgugggaugggcuaucauugacgauaaucucaagcugcuuaaaagaaacaugacgaucaagggcaauaccgacaaaaaguccgucaagcgggaucugugggggucucuccuguauagcggaaacuccgacaaaacaaccucugccgcggaugcucgcagcaagagaggccuucggcgcagacugcggcgcagaaaauaccggcucgaccgccugaagcagauuuucuccgagaucaucaaugauaaagcccccaacuuuuucgacaagcugaaugaaucuuuucucaacccuaaggauaaaaaguaugggaaauaccaaauuuucgacacagagaaggaagagaaagauuauuacagacgguauccgaccaucuaccaucugcgcaaggaccuuauugaaagcuccaaaaagcaggacaucagacugguuuaccucgcccuggcucacauucuuaagagccggggaaauuuucuguucgagggcaacaucgaugaccucaaaaaugauuuugccggcauuuaugaggaagugguggagcugugcaugacaaucaacgcugaagacgucgaucuggaguucgaggaaguggacaagcagucucucaauuccaucauuaaaaacgaggauaucagcgaaauugagcaggggcuggaaaauuuugccgacgagcacguuaucuucaaggagcaaaacaaaaagaagaacgaucuguuuucuaauuguugcaaaauuaucuguggacauaccgugaaggcgaacaaauucgccuccgaacuugacagcgagcucuuuaucucuuucaaguccgaugacuacgucgacgugauugauguuauccagagcggcaaugaaaacauugcuaaucugcuucuggccugccgcaaggcuuaugacuacaucauguucaacagacucguggaucugaauauugacucccccgccaaacugucuagcaacauggucucccucuauaaucagcacgagaaggaucugaaagcguacaagaaacuuaucaaggaauuuaacaaauucaagcggagcaauggguguaaggaccuggagaugaucauucucacggccgaugacaucgauucuuuucgcaaaaagguggacaaaaaggagggaaaacugaacggcauuaauaagaaaaucacccaugaacaggcucuuaagaagcaacugaaagauaugaagaaaauucucgaggacaagaacacagaagccgaggauaaacagaucaaugacauucugaagaugaucaccuccaucgaggaaagagugaacaagagcugcuuccugaaaaaccuccggucuacagacaaugcuagcauuccuaaccagauccagagacaagagauggaagccauucuggauaagcaggccaaauuuuaucccuuccuuaaugagcacaaggacgaacugcuccagcugcuguccuuucgcaucccuuacuacgucgggccccuuguuaacaaaaaguauucucgguucgcuuggcucgugagaaaggagggacaagugcagaaaauuaccccuacgaauuuugauggcgucguggacaagcacaaaacagcggagaaguucauggaacgccugaucggcaaagauguuuaccugccgaacgagcgggugcuccccaaggccagccugcuuuaucaggaauacuguaucuuuaaugagcugaccaaggucgcuuauauugacuccacagggaaaaagaacaauuucagcucugaagagaaacucaacaucuuugagaagcuguucaaaaccaagagagaagugaccaaaacagaucugugcaagugucuuaauaacguuugcaagcucaaagagaaggugaaagaaacggagauuaucggaauuaaggccaaauucaaugccaaguacuccaccuaucaugaccugaagaaaaucaacggcauggaacagcugaucgcugaugaggaggggaagccucucugugaagacauuaucagcauucugacaaucuuugaggauaaagacauucgccuuguccggcugaaggaacuccugugccaaaauaaagaucugaucaacaaguucucucuuuccgccgagaagcucgcgaaagugcugagcaccaagcacuacaaaggauuuggcaacgucuccgcuaagcugaucaaugggauuagagacaaaaacugcaagacaauccucgacuaccugauugaagaugacaaggaggccuauuacggacgcaauaaccccaaucggaaccuuaugcagcuggugaaugauucuagacucgccuucaaaggccagaucgaccgggagcagaacacccaucuggaagaucugagccuugacgaguuucucgaugaccuguauguuuccccuucuauucgcagaggcauccggcugacgauuagacucguggaugaacuggucgagaucaugggguaccuucccaagaauaucgugauugagaugccgcgcgaagacggagagaaaggcaagaucgcugauacacgguauagcaaacuggaaaagaugcucaagaaagacgccgcucuggaggaccuguacagaguucuuaagaccuaugagaaaaacaagaaagcccuggcgaaugaugcccucuaccuguacuuccuccaaaacgggcgcgacauguauaccggaaaggaaauuaaucuguccgagcuucacagcuacgauaucgaccacauuaucccuaaaucuuuuaaguaugaugacucccuggauaacaaggugcucacagcuaaaaagaugaauauggacaaaagaaccggcgcccuggaucauaacaucauugaaaaccaguguggguucuggcggguccugcuucagcaggacaagaucagccuggagaaauacacaaaucucaugaagacggaauuuaccgaggcugauaaggccggcuucauuaugcgccaacugguggaaacaagacagaucaccaaauuuguggcgcgguaucucgacaacaaguucaauggacugauuucugaucccaacgacaaaguuaauauccuucugccucgcgccucccucugccaccaguuuagagagacauucggcuucuacaagguccgggagcugaacgacaugcaucacgcucaugaugccuaucugaaugcugugaucgccaacacccuuaauaaaaacgccuaccugagcgaccuccugaaguacggggcuuauucuaaguacaaaaagaauggauuuaacaauagcaacggcauuauggauuauuucgggaauacgcaguuuaacugucucuucguggucgaacgcacccuggacaaaugcagagugaauaucguuaagcaccccgagacagcguccggagaauuuuacaacgagaccauucagaaaaacaaggugaauggcgggagcucuacacggucccuuaagagcuccgucaaagugcugcaaaacaccgaacaguauggcggauucacgaauguuaacaaugccuacuuuauccuguucgauuauaaggcuaaaucuaagcucaaacgcaagcugauuggcgugcccaucgucgacagacaaaaauuugagcaggauccugugacauaccuugaggccaagggguucgacgaaccgaagcugguucagaaacuccugaaguacacccuccuggaguaugaagauggaaaacggagauaccuuacaggcgugaccgggaagcgcugugagcugguccgggccaaccagcugcuccugcccagaaauaugauggcccuucugcaccaucuccaagaguggcagaaacacgacuuuggaauuaaggaaaugaccaaggugaucaaaaacacaaauaacaucgaggcuaaguucgauaaacuguucgaacauaugaugaaguuuauugacaaauauagcgagccucccaagaucguguccucuaagauuagcgaagaguaccacaaacuccgcgagucccugugccaggaugacaauaagaucaaaauuuaugcggaaaucggcaaggcccuucugucucugcuccaccuggucgacagcaaauccgcuuguguuuucaaguuuagcgggcuugagaucaaccggauuagauaccagucuaucaaugaaaagaaagagccugugauuaucuuccaaucccugagcggccuccgcgaaucucgguauaaguacaaccaguga

SEQ ID NO: 4455 - RNA, 4209 nt, Artificial Sequence
  Cas9 variant
augaagcugagaaacgccaaagacuacagcaucggccucgauguggggaccggauccacaggcugggcugucacgacccuggacggggaucuuuucacauuuaaucaccggcccacccugggaucucgccucuucgagagcgccuccacagcgcaggaaaccagagaggcucggggcgcccgcagacggcugaagcgcagacgguggcgcauuucucuucugcaagaacaguuugccgcugagauggaaagcugcgacuccaacuucuuuaucagacucaaucagucucggcuguggcaggaggaucgcacagagcaagggaaaggauaucuguucggcggcaagccuauucucuguggggcccagaucuuugcuaacgaacaggaguacuaucagcaauucccgaccauuuuucaucugagaaaauuccuuguugaaugcagcgaacagguggaccugcggcucaucuaccuggcccuucacaauaucgugaaguaucgcggaaacuuucuguaccaggauaauaagacgcucaacgucagaaauuucaaccuggacucccagauugcggauuuucuggaccaacuccagcuguggugugagaauaacgaucuuugcuuccaugaaaucgacggcaccacaacccuggccagccagcucaauacauguuuccaccaacagucuaaccagcagaaaaaggauacccugaaaacguuuuucgcuacaugcauugagaaugacaagaucgccggggaacuuaccaaagcucugcucggauauaagacagacuuuaagauuaucuucaacauugagggcgaaaaagaugaguacaaggccaaauguaacgaggaagagaagauccugaaacugcaagaaaccaucgacgaugcgaaucaggugcuccugcaguccauucuuaaccuguacagcgggaucauuguugagaagauccucaauaacaccgccgugaaaaaugaaucugcucagugcacacuguccgccuaucauuguuacagcuaugcucuuuacucuaagcaacugcggacgcucaagaaacuggucagaaaguauaacccccagcgcuacaaugagugcuuuaaccuguccgccgaggacccuaaagccaagaaacagcucuguaccuaugcucgguacaaugcgcagcacagcacagauuacgacgaguucaagaaguauauuaaagaucuguuugagaacaccgacgccgugaaugaugcugccuaccaacagaugaagcaggacuucgaugaagagaaauuucuuagacgccagaagacauccgacaacggaguuuaucccuaccaauuccaccuggaagagaugcagcucaucaucgagaaucaggcccaacauuauccuuuucugaccaaaauuaagcccaagcuggaaucucuugugacguuccggaucccuuacuaugucggcccgcucacacagaaaggcauucagagaaacgggcgcaaguuugcuuggagcaaacggaauaaggacgccgagaaccagagaaucuaccccuggaacugggauuccauuaucgacaaaagcgcgucugcugaagccuucauccugcgcaugaccggaaagugcaccuaccuguauggcgaggaugugcucccuaaggagucccugcuuuaccaagaguucugcgugcugaaugaacucaacggggcccgguggaauugugacggagaaagacgcaugccccugagcaacaaagauugcaaggcuauuuaucggcagcuguuucuuaaaaagcagaaagucucuuacgccgacguuagcaauuaucucaaggcucagggccacaucaacaauuccguggccgggggacaaggcgagcauggcuucgaaucuacacugagcucccaccacuuuuucagaaaacuguuuaacguggaugcggccaaugaccucaccgcucagcagauugagacagccgagcagcugauccuuugggggacgauuuucgaagauaaggagaucuuugaacaaaagauuaaagagcgguucggagacauguuuagcaaggaugaaaucaaaaccaucgcucgcagaaaguucucuggcugggggaaauguuccaagcagcugcucagcggacugacagucgagaccccucggggcagagagucuauuaucgacgugcugcgcaacgggcaucccgaaaauggccggacacuuguuuuuaugcaagugauuaccgauaagaaacucgaguucgacaagaaaaucgaagaguacaacaaugaacaccuggccaagacgaacgaguccguccuggacaccgcgauuaugagcccggccaucaaaagaggagugaaucaggcucuccauaucguuggcgagauucgcagaaucacaaagcacgauccuaccugcauuuauaucgaaacaacccgggacgagaaggaugggaaacauaacacgcgcacauccucuagauacagcucccugaagaaaaaccuugaaacccugaagucuauugacaaagccaaugcucccgccaucaagcacagccucgagcugcuggagacauacaagaaacagaacaucgaugacaaacuuuuucucuauuucacccagaauggaaaguguauguacuccggcaagagccuggauauuaacaaucugucuuccuaucagaucgaccacgugauuccucaaagcuacaucaccgauaacucuuucgacaaucggguccucguguaugccuccgaaaaccagcgcaaaagcgauucucugcuucugagcuccgucauucaggcuaagcaggagcccuuuuggacaagccucgaaaaagcggggcugaucucugagaagaagcauaauaaccugaaaagaaagucccuuagcgacgcccaaaucaaaggauucauuaaucggcagcugguggaaacgucccagaucguuaaggugcuccgcgaugagcugucucggauucuccccgacaccaaaaucauuccugucaaggcuagccugucccacgacgugcggaucgccugcaaccuuuacaagucucgcacagccaauagcuuucaucacgcucacgaugcccugcucgcguccaccaugggcagauucguucagacacgguuuccggacauguaugagaaccccgugagauacgucaaaauucugcgcgcuuacaucgcccaaucuaagcugcagcauagcgcccagacccggaauuucgauucccgcagcuuuauggcucacucuuucuuuugugacuauuccaacgaaaacggggauacgaucuggaauagcgccucugagauugaaagacuucggagagcgcuguccuacaaaaaccucuaucugacacgccggccuuucaucgacgcuggccaguuuugggaucaaaccauuuacagcccccaugacaagaaaaagaccccugauucucucaucccccugaagaaaaaucuugacacacagaaguauggaggcuacuccgggaaagauuaugcccacuucuucauuuacagcgugcugaacaagcagggagacguggaguacagauuugacggcguuccgcucuauaucgccgcuaauaucaaccgcgaugacagaggggcccuggcucaauacgccaaacagcuggucgaacaugagaaugugccuaacgcgaagagaaagaccaaagaucuuguguuccagcggauugagcgcgccugcguccccaaguaucagcugaucuguauuucccaaugcagcggagacucugauagaagcguguccgacuacuauuacaucacaggcaaaaaggaaguucggaaugcucuccagcuggccuuuccuaugcaccucuauggggcuauuaacgccaucgaggauaaaaaggaacuggacgauucugcccuugaggaacugguggucuacauccugcgcaaugcucccagaauugcgccugacguguuccggagacucaaccugacggagaaacuugccgauugucuggacauccccgaucgcauugagcuccagaauagcaucuacggccuguuuaaccucauuaaugcugaauccaacguugugaaucugcagaucuucggaggcgccaagaccgccggggucaaacuuauuaaccugaacucucugcucaaugacccggcuacaaccgugacauuuaucgaccaaagcguuaccggaauguucgagcggaaggaaacgaucggcauuuccuga

SEQ ID NO: 4456 - RNA, 4209 nt, Artificial Sequence
  Cas9 variant
augggcaagcaggaguucaacgacuacuaucugggguuugauaucggaaccaauagcgugggcugggccgucacagaccaacaguacaaacuccugagauucaacaagaaagauaugugggggucccggcuuuuugaagaggcuaagacggccaaagaacgcagaguuuaucgcaauucucggagacggcuggaccgcagaaagcggcgccucaagcugcuugaggaacuguuccucgaugagauucugaaaguggacagcaccuuuuucaagagacuggaggaauccaaccucuacaaugaggauaaaucuaucaaguuuaacuauccccuguucaaugacaaagauuacacagacauugauuuuuauaaggaauacaagaccaucuaccaccuucggaaagcgcugguguucgaggaccgcaaguuugauauuagacuccuguucaucgcccuucaucacauccugaaauaucggggacauuuuauuuucgagggccagagcuucgaagacaucaaguccuuugacuacauuuucacagagauccaggauuggauucucgaaaacuuugagaucaauauugacaucaaccugaaagaaaagcuggaggagaucauucucucuaauaacaccaaaagcaucaagaagauugaguucaaaaagaucuuuuccgauaaucgcauucuggcuauccuuaacaugggggucggaugcaaaguggaccugaaggauguuuucaauaacgaggaacucaaagaccaaaagaucagcuuuacagagauugauuaugaaaacgagaagagagacgaguucuaccagcugcuuggcgaaggcaucuuuauuguggaucuggccaaaaagaucuaugacuucaugguccucaaaaagauucugaaaaauucugauuacuuuuccgagagcaagguggcucuguaugaggaacacaaggaagaccucaaccggcugaaauacaucuucaagaaauaccuuaagucuuccgacuauuacaaauuuuucagaagcaauucugagaagaccaacuauccuuccuacaucgggcugaauaagauuaaaacgaagcgccucaucgagaacaauaaauguagcauuuccgauaucaacaaggaacugaaaaauaaguaucuuaaagacauucagguugaggccgaagaugaggagcuguucaaccggauccuccauaagauuaaugaaaacaaguuucuggagaaacugaagucuagcgaaaauuccaccgugccguaccagguccacgagaucgaacucaaaaagauccuggacaaccaaagaaaauaucacagcuuccuuaaugagaagucugauggaaugacacugugcgagaagauuaucaaacucuuugaguuccgcauucccuacuacgugggcccucugaacaccaaccccaauaugaacaagaaaaauaagaacacauggguggucaaaaaggaagaaaauuccaagagcucuaucaccccuuggaacuuugagaaaaagguugacgaacagaaaagcgcugaggaguucauuaagcggaugacgaauagauguacauaucugcgcggggaagaugugauccccaaaaacucccuucucuacgaggaauuugugcugcugaaugagcucaacaaggucaccguggacaaugaacugcuucauccuacacugaagaacgagaucauugaugaacucuucaaaaccaccguuaaggugacaaagaagaaaaucacggaauuucugaagaaaaagcaggccauuucugacgucgagagcaucaccggaauugauguggaguucaauggcaagcugcagggguauaacacauuucggaaaauccuuggagaaaagaucgagaaucucaacauuaaaaaguucguugaaagaugcaucgagcugaaaugucuguacggcuccgacaagaagcucuuuaaaaacgcggugggcaagcuguauaaagaauacaaugucaccgaugaggaguucacaaagauuaacaaacuuaauuucaacaagugggggcgccugagcaaggaauuucucaccggaauccgguucgagaaaacggacggcacagaaagauuugagucugugauugccgcucugcgcuccaccaauuauaaccugauggaacuucucagcgacaaguucaaucugcaaucuaaaaucgaugagaucaacggggaagacgauuuuuccaauauugacaucaaggaguacgucaacgagcuguacgugagcccguccguuaaacggucuauuauccagaccuauaagauugccauggaaaucaagaaaauuacaggaaagaaucccaaaaagguguucaucgagauggcuaaaggcgggggagaaaagggcaagagaaccgagcggcgcaaagauaagaucaaagaacucuacaagaacaugaaagacagccuguccgauuauugcaauaaccuucaggaccugucuagccaagucgagaaguacgaugacaauagacuccggcagaaaaagcuguuucuguauuucaugcagaugggcaaguccauguacacagggaacgauauugaccuuagcgagcucuuuaacaauaacaucuaugauauugaccacaucuacccucagucuaaagugaaggacgauuccuucgacaauauuguucugguggaaaaacaagagaaccauagcaagucuaaugaacugcucaaacccgagauccaguccaagaugaacaauuacuggaucuuucugagagagaacaaguucauuagcaaagaaaaguauaaucgccuuacgcggaaaaagaacuucaccgaugaggaacugggagacuuugucgccagacagcucgugacaacccgccagucuacaaaagagguggcgaagcuguucgaaaagaucuuugauggcaccgagguugucuacagcaaagccucccuggugagcgacuucagagagcgguuugauauuaucaaggugcgcgaagucaaugacgcucaccacgcccaagaugcuuaucuuaacauugugguugggaauguguucaacacgaaauuuaccaagaauuacuggaaauucaucaaggagaacaauagaaagaacgaagagaacccuaauaaaaaggaaggauauaacuuuaaaaauaucuacgagucugacgucuuccggaacgaggauguggccuggguguuuuccaaggaaaauaaagagauuaacacaaucaagaccguuaauaaaauggucuaucgcaagacagugaacauuaccgaaaugcugguugagggcaaggggcaacucuucaaucugacgaucaaagacagaacacagcucaagaaaaaggugggcaacauugucgccaauauccccaaaagccugaagaaccggaauaccaaacuuaaauccgacgaacuggcuaagaaauacggauacuuugauucucucaacaauagcuauuucgugcuguucaaguacguggagaaagagaaggaaaagauuggcuuugacgggaucacaaucgucgauaaagagaagcugaaaaagaacuccgacauugaacgcuuccuugagaacaaaggaaauaagaacgcgaagcugaucagaaaaauuuuuaagaaucagaaaguucucaucgauggcuauccguaccugcucaagucuuguaacaaagacaaggccauucgguucgauaauuuuaaaagccuguaucuugacgagaacgaucugaaguucacccgcgacgcuaucaaguuugaaaagaauaacgccgauaucgaccucaagaaacagaaguacauuaucuccuuccugaaaaagaagaaacagaaugagauuaacgaaaccuaugaggaaugcaucgagagacugaauaacgaguuugauacacuuuuccugaaucucugugacauucagaagucuccuaucuacaaaaacuacaagcugcccgacuuuaucagcaaaaagaaugugguggaagucaaggauaaauucgagguguuuaagaaccucgaacuguauaacaaauccaaacuuauuaaaaauuuccugaacuacuucaaguaugacaauaacaagcuggaucucaucgccauugggaucgacagcaaagcuaauugcauucagaagcauuuuacggaggaucugaucaaagacuucguuauuguggaugaaucugucaccggacuuuuugccaagaaagagcggcuggaguga

SEQ ID NO: 4457 - RNA, 4209 nt, Artificial Sequence
  Cas9 variant
augaccuacagaaacuaucacaucggccuggacauugggacaagcuccgugggauucgccguccgguacgauaauggcgagcucguucauaagaaagggucuaaccuggugggagcucgccuuuuuaaggaaggcgagacggccgaagagagacggcugaaucgcggggcgagacggcgcuauaacagacggaaauggcgccucaaucugcuuaaccagaucuucaagccccugauugaagugaaugacccuaccuuuuucaaaagacucgagcaaagcaaccuggucaauuacgauaaguccgagucuuuuagccugcucaacaaucaguccgacgauaagcugcaccagcaguucccgacaaucuaucaucuucgggacuaccugaugaaaucuaccgaaaaggcugauauucgccucaucuaucuggccgugcaccauaucguuaaauacagaggaaacuuucuugacgccagccccguggauuccuucgaggcuagcaaucugaaggucgacgaaauucucacacaaaucaaccugcugcucgauaaucugaccgacgaucuucggcugaacacacaguacgugaccgacauugagcagacgcuccugucuaacaccgaguccaauaaagacaaggaaaagguuauccagaaacuucugcuccacaaggaggccauuaaaaucgauaaggaccgcacagcucaaauugccaaacuggugcugggcuauaaggcggauaucgccaaacucuuuggcaucaccgaaaagcugcagacaccuaaacuugagcugagcgcugccaacucugacgaugcucucauggaacuguccgccgagcuuaaugaggaccagauugggauccugcuccagcugaagacccuguacagcagaguccggcucaaccaaauuauccccucuggaacgucccugagcaaguccaugauugaaaaauaugagcuucaccauacacagcugaagucuuucaaagaaaauauccuccugaagcugagacgcaacaccgcggugcggagaaaucuugagcucgccuacgcucuguaugugggcaacgcccagacaaagcaagaagucuuugagccuaaaaaggcucgcuucaccagcgaugacuuugccucccugaaagccaaugcuaagagcgcgucuuccguuaaagaggcccccaagaacaccaagacaaaacucacgaccgaugacuucuacaauauccugacagaacuuuucgcuaccuuugagagcgaacugucugccgaugaggacaugauuaaggaaguggagcagaucaaaaaggccauuacaggggacaacuaucucccuaaacagcggaccgaucagaauggaaacaucccgcaccaacugcaucagauugagcugagacagauccuucagaaucaacucccccacuacccugaaauggacaagaucaacgagcagaagcccauugaaaaacuggugacguuccgcgucccuuacuauaucggcccccugauuacaccggaggaucagcagaaguccuccgcugccaacuuugcguggaugaaacggaaggagcaaggggcuaucaccccuuggaauuucgacgauaaaguggacagaaugcagucugccaccaacuuuauuaagcgcaugacaguuaaagauaccuaccucaucaaugaagacgugcugcccgaucggagccuucuguaucagagauucaagguccucaacgagcugaaucuggugaagguuaacaaucagcuucucuccauuggagaaaaacaagccaucuaccacgaccuguuugagaagcagaaaacagugagcacgaagaaacugcagucuuaucuccaauccgaacagggcuacggcgauaacaucgagauuagcgggcugucuaauccugacaaguucaacaauggacuuaccacauauaucgauuuuaagaacauuuucggcgaccuggucgaggacaccacaaaacagaaggaauuugagcagaucauugaaugguccaccguguucgaggaucgcgcuaucuuuaaagccaagcuccaagaagucaauuggcugacggaggagcagaucaaagcucugguggccaagcgguacagcggguggggaagacuuuccuaccggcuccuggcggaacugguuaacgacaauggcgagcgcauuaucgauauucucuggaacaacaaggggucuaaucugaugagcaucgugucccaggacgaguuccagcaacagauugccagaaucaacucucaugaaguccaggaacuuggaauggagagcgugcuggcuaaugccuauaccagcccccagaacaaaaaggcuauccggcaaguuaugaaaguggucgaugacauucagcucgccaugaauggccaggcgcccacaagcaucucuauugaguucaccagaaagccugaagagaacuccgaaaucagcaaaucucgcuacgagacaauuaccuccaucuaucaaagccugucuaaggauaucgagaaggaagugaaagacaaucugaacaagaauaaaagcucccuuaagaaaaaccugagcgauaaguacuaucucuacuuuacgcagcugggccgggacauuuauacaaaucagccgauccccuucaacgagauuccuuacuacgauaucgaccacauugugcccagaucuguugaaaugaaugauucccucaacaaucgcguccugguggccaaaagcaucaaccagauuaagaagaacaaugcuccuaucgacuccucucuuaaaaucaccagcgagacaagacaacuguggaagaaacuccuggacuccgggcugauuaccaagcagaaauauuacaaacuuucuagcuccaucaagaacaccgugucucccuaugucaagcagggauuuauuaaucggcagcugguggaaacaagccaaguuaucaagcucguggccaacauucugggcacgaaauaccagaaugaugacaccgagaucaucgaggucaaggcucaucucaacuccgaaauucgcaaaacauucgaguuuuauaagcugagagaacuuaaugauuaccaccauggguucgacgccuaucugaccacacucgugggaggcuaccuguacaaccgguauccgaagcugcgcagcuacuuuguuuauggggaucacaaaagacuugacaaggcccagcugucugagcucaaaaauuucaacuuucugcacggccucaccaauccuaaguccggaagcgauggccugaucacggcuucugggucccagcaagugguccuugaccggaacgaaacaauuaaacgccugaauaagaucuacagauauaaguacaugcugauuagccgggagguguucaccaaacagggacaguuuuauaacgagaccaucuaccccgcgaagccuaauacagccaaaaugaucccccucaaggauaacaaaccuucugaaguuuacggcggguauuccagcuccaaugugagcaagauugcucugaucaaggagaaaaacaccgacaacuaccaguucauuggaauccccauucgcucuaucgccaaacuuaagcaagccaaggcuaauagcaaaacagucuaucagacggaacugaacagagugauuaaguccgugcucgccucucagaaaaccaagaagcaaaaagaguuugaagucauccuggauaauguuaaguacaaccaggugguggucgaccagggcgagaaauauuaccucgggagcccguauuacaagaaaaaugcgaagcagcuggugaucuccccugagucuguuaagauucuugcugacaaagccacagccgaucugcccgaacaagaggcucauaacaagcugaugaccguguaccaggaaaucgucgacgugcucaauaaacacuucgcccuguaugauauuaacaauguucggaagaaacuuaacgacggccugaucaaguucagccagcuccccaauuacgaugagacauccaagaacagauuugacauuucuaaaagcaucaagaccaaauaugcggugaucaugcgcauucuguccggaaucaagaaucagacgagcgaggucccugaacucggccugaaaucuccgcuuaacaagaugcaaaccaaagggggaauuaagaucucccccgaggcuaagauuuacuauagcucuccuacaggcaucuucucccauuuuaaacaggugaagaaucuguga

SEQ ID NO: 4458 - RNA, 4209 nt, Artificial Sequence
  Cas9 variant
auggagagaauccugggccucgaccugggggugagcuccauuggaugggcccuugucgaagaggauguuaagaaccccgaaaauaacaaaaucauuaagcugggcgugcgggugaauccucucaccaucgacgagaaaacaaacuucgaaaaggggaaaucuauuacgaccaaugcuggacgcacaagcgccagauccgcgcggcgcaaccugcagagauuuaaacuucggcgcaagaaacugcucgagauccugauccacuacaagauuaucaaaaaugaugcuguccuggccgagaccggcaagaacacaaccuuccaaacacaguaucucagagccaaagcugcccgggaaaagauugagcuggacgaacuugcucgcgugcugcuccugaucaauaagaaaagaggguacaagucuagccggaaaguucagaacgaugacgauggaaaggccauugacggccuuuccguggcgaaagagcuguaugagaagaauuacaccccgggccaguaugccuacgaucuccugaaacgcgggaagaagcaaauccccgacuuuuauagaucugaucugcagaacgaacucgaccggauuugggaguuccagaaacaguaccauccugauauccugacggacgaauuuaagaaagagcuugaaggaaagggccaacgcgcuaccgccgcuaucuuccugaauagauacaaaauuuauacagccgacaacaaggggacccgggaggagaagaaaauccaggcguaccaguggagagucgaagcccucagccagccccuggaugugaaggagguugcuuaugugauugccgaaaucaauaacaaccuuaauaacuccagcggauaccugggcgcuauuucugaccgcuccaaaaagcucuauuuuaaugggcaaacaaucggagaguaccuguucgaggagcugagcgccaacccucacacccggcucaaaaaucaggucuuuuauagacaggauuaccaagacgaguucgaaaagaucuggaagauucagacgaaauuucaucccgagcugacaaaggaacuuaaagaacaggugcgcgauaucgugauuuucuaccagcggaagcugaaaucucaaaagggccucaucuccuuuugcgaguucgaaagcagagagauugaaaucgaggaaaacggcaagcgcaaacggaagaaagucgggcugaagguugccccuaaaucuuccccgcuuuuccaggaguuuaagaucuggcaagugcugaauaacauugagaucaaaaaugaagacgagagacgcuaucucgaacccgaggaaaaggagcugcuguucaacgagcucaauuguaagggaaaccugaccagccagaaaugccuugaacugcucggcuuuaaguccaaagaugcuaagcugaauuucaaaguggucgaggggaaccggacaaaugaaaagcuguacgacgcguuucuuaagauucucgagcugcagggauauaacguguucgaacugcucaaaaucaaggaggauaaagacgaggccaagcugucugaacuuaaagcuagcgccgaugagauuaagggcaugaucaaggaaauuuuuaacgccaaucugaucaacaccuccauccucgacuucaaugcugagcuggaagggaaagacuuugagaaccaggccagcuaccaguucuggcaccugauguauucuuacgagggagauaauuccccuagcggcaacgaaaaacuuuaugagcuccuggaaaagaaguuuggcuucaaaaaggagcauucuaagauucugagcaccaucguguuuucccaggaguacgggucucucagcacaaaagcgaugagacgcauuuaccccuauaucaaggacaauaaauacuccgaggcuugucugcuugccggauauaaccacagcaagcacucucugacgaaagaagaacucgagaaucggaagcugaaagaacaacuggagguucuuccuaagaacucccucagaaaucccgucguggagaagauucugaaccagaugaucaaucugguuaacgccaccaucagcgaauacggcaaacucgauggggugcggauugagcuggcucgcgaacuuaagaaaucugcccaggagagagaagacauggcuaaguccaucaaugaggccacacugcuccaucagaaauaugcgaccauucugaagcaagaguucggagucgugaacccgagccggaacgauaucauuagauacaagcuguauauggaacuuacagucaauggcuacaaagaccucuacaccaacacgaagaucgagaaagaaaaucuguucacagauaaguaugacaucgaucacauuaucccucagucccgcuuuuucgacgauucuuuuagcaacaaagugcugguuccccggcaguccaaucucgacaaggggaaccugaccgccuacgauuucaugucuaauaagggcagcgagagagaggaacauuuucuuaacgugauuaaagagcugcucgacaagggauccaucagcaaagcuaaguaugaaaaacugaagaagaaaggccuggagauuggggacggauucaucgaacgcgaucuuagagacacccaauacaucgccaagaaagcuaaggagauucuguuugagaucacaaauucugucgugaccacauccggccggauuacggauaaacuccgcaaggacugggaucugguuaacaucaugaaggaacucaaucuggacaacuauagacggcuugggcugaccgagauugugcgcaauagcaaaggagaagagaaggaacucaucccugauuggacaaaaagaaacgaccaccggcaccaugccauggaugcgcugaccgucgccuucacaacccgcaaucacauucaguaccugaacuaucuuaacgcuagaaaggacgagaaacauaaggagcaccagaauaucuacgccaucgaaaacauuaucacggaggugauugaaaagaagaauggcucuaagacccggcgcuuuaaagcucccaugaacuccuucagacaugaggccaagcagcaccugaaagaaauccucgugagccacaagaccaaaaauaagguugucacaucuaacauuaauaagaccaaaaagaaagggggcauccauaagaaaacagagcugacgccccggggacaacuccacaaggagacaguguacggcagcaagaaauuucugcaguccagagaagagaaggugagcgccaaauucgauuaugaaaccauccuuauggucgugaacccuauucaucgcaaugcucugcucaaccggcugaaggaguacgggaaugacccgaaaaaggcguuuucuggaaagaacgccaucaauaaaaaccccguuuaucuggaugacuccaagacagacauucuuagcgaaaaagugacccuguccugguacgagaccggcuauacaaucagaaagucugucacgccugauaauuucaaagacuacaagaaccucgagaaaauuaccgaucuggggaucaagaagauccucaaagaacgccuggaccaguucaagggaaaugcuaaagaggccuuuagcaaccuugauaaggaccccauuuggcugaacgaagagaaaggcaucgccauuaagacagugaccaucacagggguuuccaaugcugagucucugcacuucaagaaagaucaccucggcaaggaaauucuggacgagaacggaaauaaaaucccuggcgauuuugugagcaccgggaacaaucaucaccuugccauuuaucuggacgaagaggaaaagcucgaugacaaaauggucacguucuacgaggcggugcugcggguuaaccagggacuccccgugaucgacaaggauuacaauaaggagaaaggcuauaaguuucugaugacacuuaaacaaaacgaaauguucgucuuuccgaaugaggacuucgauccuaacgaaaucgaccugcuggaugagagaaaucucgaacgcauuuccaagcaucuguuucgggugcagaaaaucucuaaggugggguacggaaacagcuucgucagagacuuuguuuuccgccaccaucuugagaccaccguggaggaacggaaggagcugagaaauauuacauauauccagcucaaaucccuggaaggccuccggaacauuaucaaggugcgccugaaucaccuugggaaaaucguccagauuggcgaguacuga

SEQ ID NO: 4459 - RNA, 4215 nt, Artificial Sequence
  Cas9 variant
augaccaagaacauccugggccucgaccugggggugagcuccauuggaugggcccuuguccaggaggauucuaaaaaucccgaaaacaauagaaucguuaagcugggcgugcgggugaacccucucacagucgacgagcaaauuaauuucgaaaaagggaagccgaucacgaccaacgcuagccgcacacuggccagauccgcgcggcgcaaucuucagagauuuaaauuccggcgcgcuaaccugauugaugugcucaagaagugcaauauccugaaacagggagaccugcucaccgagaucggcaagaacucuacauuucagacccaagaacugagagccaaaagcgccaaggagaaaguugagcuuuccgauuucgugcggguccugcuccugaugaauaagaagcgcggguacagaucuagccggaaagcuaagaacgaagacgagggacagauuaucgauggcauguccguggccaaaaagcuguaugaagagaaucuuacacccggcgaguacagcuaucagcuccugauugaaaacaaaaagcagcugccugacuuuuaccgcucugaucuccaauccgaguucgacagaguuuggaaauuucagaagcaguucaaucccgaaauccugaccgaugaccuuuauaaggagcugcaggggaaaaacaagaacgcuacgugggccgugcucaaagaaccuuuuagccuggucggaauuaagcaaaucggcaccauucaggagaaaaaggcggagaaguacuucuggcggucugaagccgugaaacgccagcuugauuuugagucccuggcuguggucuuccaagaaaucaauagcaaccucaauaacucuuccggguaucugggagccaucagcgacagauccaaggagcuguacuuuaauaaccagacaguuggcgaauaccucuuccagcagcugaaagaaaauucucacaccaaacuuaaaaaccaaguguucuaucggcaggacuaccuggaugaguuugaaaagauuugggagacacagagcaaguauuacaaagaacucaccaaggagcugaaagaagagaucagagacauuaucauuuucuaucagcgcaaacuuaaaucccaaaaggggcugaucagcaucugugaguuugaaaaucgggagauugaaaucacggagaacggaaagauuaaaaagaaaacagugggccucaaggucgcucccaaaucuuccccucuguuccaggaguuuaagaucuggcaagugcugaauaaccucguuuuccagagcauugaaucuaaagagcuguuuccgcuugaucuggacaucaaggaaagcaucuucaaugaggugaacauuaagggcaaucucuccgccaaaaacguccuggaucugaugggguacucuggaaaggaauggaaaaccaacuuuaagaauaucgagggcaacagaacaaaugagaaccuuuauaccgcguuccucaaaauuaucgccagcgaagggauugaguuucccaaggaguucaagcuguccaucgacgaugacauuaaagugagcaagaucgauaucucuuccgagaaaauuaaggaauuuaucaaagagaauuuccugaagcucggaauuaacaccagcauccuggacuucaauccugagcuugauggcaaggacuuugaaaaacaggagucuuaccagcuguggcaucuccuguacuccuaugaaggggacgauagcgcuuccggaaacguuaagcuguacgagcuucucgaaaagaaguucggcuuuaaaaaggagcacucuaagauucuggccgacgugggcuucagccccgauuaugggucccugucuagcaaagcuaugcgcaagaucuacccuuauaucaaagagaauaaguacuccgacgccugccaucucgccggauauaaccacagcaaaaauucuuuuacaaaggaucagcuggcuaaccggauucuuaaagaacagcuggagauccuccccaagaaugcgcugagaaacccggucguggaaaagauucugaaucaaaugaucaaccuugucaacgaggugauuaaagccuacggcaagccugacgagauccgcaucgaacucgcucgggagcugaaaaagaaugccgaagagagagccaacaugacguccgauauuagcaaagcuacccugcuccaucagaaguacgccgaaguucugcagaaggaguucgggaucaaagcgcccucucgcaaugacauuauccgguauaaacuuuaccuggagcucgaaaagaaccuguuuaaggaucuguauacagacgugcaaauuaagagagaggaacuuuucaccgauaaguacgacaucgaucacaucauuccucagucccgcuuuuucgacgacagcuuuucuaauaagguccucgugccccggggagcuaaccugaaaaagggcaauuucacagcccuggauuauauggagaucgaagggaaagagaagcucgagaaauuucugaacauuaucaaggaacuuuucgacaagggcgccauuagcaaagcuaaguucgagaaacugcagaagaaaggauccgaaaucggcgagggguuuauugaaagagaucuccgggacacccaguacaucgccaagaaggcuaaagagauccuguucggaauuacgaauagcguuaucucuacauccggccgcauuaccgauaagcugagagaggacuggaaccuugugaauaccaugaaagaacugaaccucgagaaguaucggaaacuggggcucacagaacugaucgucaauagcaagggagaggagaaagaaagaauuaucgauuggaccaagcgcaacgaccaccggcaucacgccauggaugcgcuuacaguggccuuuacgacccauaaucacauccaauaccugaacuaccucaacgcuagaaaggacgagaaacacaaggaacaucagaauauuuucgccaucgagaacacaauuaccgaaaucguggagaaaaagaauggcuccaaagagcgcagauuuaagcugcccauuaagaacuuccggacagaagcuaaaaagcagcuggaggaaguucuuaucucucacaaagccaagaauaaagucgugaccaagaacaucaauaagauuaaaaagaaagggagcaucauugcgaagacggagcugaccccucgcggccagcuccauaaagaaacaaucuauggauccucuaaguuucugaagaccaaagaggagaagauuagcggcaaauucgaucucgaaaugauccaaaaggugcagaacgagaaauacagaaaugcccugcuuaagcggcugcaggaauuugggggagacuccaaaaaggcuuucacaggcaagaacgucauuucuaaaaauccgaucuuucucaacgccgagaagaccgaacagcugcccgagacggugacacuggcuugguaugagaccggguacacaauccgcaaaguugugaauccugauaacuucaaggacuucaaaaauauugaaaaggucaucgacaagggagugagagauauucuuaccgagcggcugaaagaauuuaacggcaauagcaaggaggccuucuccaaccucgagaaaaaccccaucuggcugaauaagagcaaagggauuucuaucaagaccguuacaaucacgggcauuaacaaugccgaagcucuccacuauaagaaagaccaucugggaaaggagauccuugaugaaaacggccaacgcauugcgguggacuuugucuccaccgggaauaaccaccacguggccaucuacgaggaugacaauggaaaccugcaggaaaaaguugugagcuucuaugaggcugucgagagagugaaucagaaccugccuauuaucaauaaggaauacaacuuugagcucggcuggaaauuccuguuuacaaugaagcaaaaugaaauguuccuuuuucccucugaugacuucgauccgaaggagguggaccuguuugaugacaaauaccucucccugaucagcaagaaccucuuccggguccagucuauuuccaucguucaguaugggaauagcgugauucgcgacuuuaaauucagacaucaccuggaaaccuccgugagcgaugagaagaaacuucagggagucacauaccaacagaucaagucucugcagccucugaaagacauuaucaagauucggcucaacaaccugggcaagaucgugcagaucggggaguauuga

SEQ ID NO: 4460 - RNA, 4215 nt, Artificial Sequence
  Cas9 variant
augaagggcaacaucgagaaaaagaaacaggaguucaaugacuacuaucugggguuugauauuggaaccaacagcgugggcugggccgucuccgaccucucuuacaaucugcuuagauucaacaagaaagauauguggggagcucggcuguuugacgaagccaagacagcgaaggaucgcagaguuaaacggaauagccgcagacggcucgaacgcagauccaagcggcugaaauaucuugaggaaaucuucgagacggagauuugcaagaucgacaaaaacuuuuuccgcagacuggaagagucuacccuccacaaugaagauaagacauuugacuuccgguuucccauuuucaacgaugagaauuacaccgacaaggaguauuacaaagauuuuccuacaguguaucaucugcgcaacgaacugaucaagaaugagaacaaaaaguucgacaucagacucauuuaccuggcuauccacaauauucuuaaauaccgggggcauuuuaucuucgaaggccaagauuucgacagcgugaccgacuuuaaggaggucuucuccgaacugucugccuaucucagcgagaaccuggaggaaaaucuugauauuaaccugugugacaacaucaaagauauuaucugcuccaaggagaauaagacaagcaaagggaagucuuuugugucccucaucgacagcaaaguuauucagucugugcugcgcuguugcaucggauacagagucaaguucaaagauauuuuuaucaacuaugaagagaaggaaaagaaugagggcauuaaccuguccgagaucgaauacgacgagaaacgggaugaaaucgcccucagccugggcgagaauauucuucugaucgacauuuguaagaaaguguaugauuucaugauccucaacaauauucugaaggggaacaaauacaucucugaauccaagguuaaucuuuaugacgagcacaagugcgaucuguguaaccucaaauacaucuuuaagaaauaccugccgaagaaagacuauuucgaguuuuucagaaaugaaaacaaggagaagaauuacgugagcuauauuuccucuagccugaacaauggaaagaagaaaaauaccugcacgcaggaagaccucaacaaggagaucaaagaguacauugcuaagaucaaagaauaugaggaaaacgaugccguccuggagaagauuaaccuuaagcugaaugaaaacaaacuccugcccaagcugaaaaccaaugacaacggcgugaucccuuaccagauucauaagaucgagcuugagaaaauccuccaaaaucaguccaaguauuacgauuuucugcuggaaaagauugacgggaucacaaacauugagcgcaucgaaaaacucuucaccuuucggauucccuacuauaucggaacacugaagggcaaauucagcugggcuaagcugaaagagaauaagaagaucaccccuuggaacuucgaaaagauuguggauauggaggagucugccaaggcguuuaucgaaagaauguccaaucgcuguagcuaccuuaaaacggagaacguccuccccaaaaauucucugcuguauagcgaauacgagcuucucaacgaacugaauaaaguuaagauuaagaacgaguucaucaacguggugcugaaaaaugagauuaucgacgaacucuuuaagacaaccuccaaagucacaaagaaaaaguucguggauuaucugaaaaccaagcagaucuuuguugagaaggaagacauuucugggcuugauaacgaguucaaaagcaagcuggacuccuacaucaaauuuaagaaagugauuggagauaagaucgacacccuccggggcuauaauuucgucgagaagugcauugaauuuaaauguuucuacggcgaugacaagaaacuguuuaagaacgccaucaauaacacagaguucaaagacuacgugagcgaugacgaacugaagaagaucaauaaaaugaaguuuaacaaaugggggagacuuucuaagcgccuccugacggagauuugcuucgaaaauguuaucgaguccgagagcuucgaaaacauuaucguggcucugcggucuaccaauuauaacuuuauggaguucacauccaaaaaguuuaaucucagcgaaaaggucgccgaggaaaaccaggagaauacccuggagaaauucaacauuaacgaauacguggaugagcuuuaugucuccccuucugugaagagaagcaucauucaaacauacaaaaucgcuauggaaaucaagaaaauuaccggaaagaauccgaagaaaaucuuuauugagauggcccgcggcgggggagaaaagggcaaaaagacggagaaacggaaggagagaaucaaaacacuguaugcgaacaugaaggacuccaaugaagaguuccucaacaaucuggauaaccugaagcucucuguugacaauuacgaugacaaccgccuucgggaaaagaagcuguuucuguauuucaugcagcucgggaaaagcauguacaccggaaagaauauugaucugaacgagcuucuguuugccaauaccuacgacaucgaucacaucauuccccaguccaaacucaaggacgauagcuucgacaacaucgugcuggucgagaagacaauuaauaaagacaaggauaacagagacuaucuggaugaaucuauccggcuucgcaugaauaaauuuuggaacuuccucagagagaagggcuucauuaccaucgaaaaauacaaucggcugagacgcaacacauauuuuuccgacgaugagcugagcggcuucaucucucggcagcucgugacgaccagacaauccacacuggaaguuaagaaacuuuuugaguucauuuuucagaacaccgacguggucugcagcaaagcuaaucuggugucugauuuccgcgagaaguacgggaucauuaaagugagagaccucaacgaugcccaccaugcucaggacgccuaucugaauaucguugucggaaacguguuugauacaaaguucaccaaaaauuacuggaaguuuauugaagaccggcgcaagguggacaacaucagagagacguauaauuucaaaaagauuuuugauuacgacgucagccggggcgaaaacguggccuggcugaaagauuacuccaucaauaccaucagcgagaugauuaacaagaaaacagcuaauaucacccaaaugauuacagaagggaagggacagcuuuucgaccugaccauccucaaaaagucuaagauugauaaaaagcugacgguuaucccuaacacacccaaaauccucaaguccagccugaaagacuccuguaagauugcggagaaguauggcuacuuuucuacccuuaugccugccuauuucguggucuucaaauacaucgauaagaauaaagagguguuuggguucgaccgcauuuuuaucuucgauagagaaaagauuaacagcaaugaggacaucgaaaaauaucuggaggauaagggcuacaacucccccaaguuuauccggaaaguuaaccucaagcagaaaauucugcugaauggauauccguaccgcaucgugggcuucacagacaacaaacuugaaauuaaaaauucuaagcaguuuuacagcgauggggagcaccugaaguauaucaaacaucucuccgcuuucuacaacaauaacaauaacgucaagaauggagaguauagaauuaacuuucugaaaaagaccucugaaaaugaccggaacgagaccacagacgaagccaaagagcgccucaauaucgaguucauuaagcuguacgaauauuuuugcgagagacuuaacagcaaaaucuacgccaauuauuacaacuccaagaaguacgaugaacugaucgagguguucgacuguuuuaaaaaccucaaucugcuggauaaggcuaaacuucugcucgaguuccugaagauuuucaaaaaggacacguauggcaacuuuaagcuccuggaaaaaccugagcuugauaagaaugggaaacaaaagcuggacaaaaacggaaaucugagcuucgaaggccucucuauggccuuugggaagcugaacggcaagaaauucaagcagcuuguugagaaagauauccaguuuguggacgaauccgucaccggacuguucgagaagaaagaaggccucgagaaguggcaggauggggagcaauga

SEQ ID NO: 4461 - RNA, 4215 nt, Artificial Sequence
  Cas9 variant
auggccaagaaaauccugggccucgaccugggggugagcuccauuggaugggcuaucgucgaggaagaugccgagaacguuaugaauaacaagauugugaaacuuggcgugagagucaauccccugaccguggacgaacagaucaacuucgagaaggggaaaccuauuacaacgaaugcgggacggacccucguucgcggcgcuagacggaaccugcaacgcuuuaaacuuagacggcugcaccucaucgauauccugcagaagcgcaauauucugaaacaggccgaccuccuggccgaaucugggagaaacagcacauuccagacccaagagauccgggcuaaguccgccaaacagaagguggagcuuucugaacuggcucgcguccuccugcuuauuaauaaaaagagaggauacaagagcucccggaaagccaagaacgaggaugaaggccagaucguggacggcaugucuguugcgaaaaagcuguaugaggagaauacaaccccgggggaauacagcuaugagcuccugaaauccggaaagaaacagcugagcgauuuuuaccgcucugaccuccaagccgaauuugauagaguguggaacuuucagaagcaguucuaucccgagauuuucuccgacaaucuguacaaggaacuucagggcaaaaacaagaaugcuacauggaaaauccuggagauuccuuucagccucgucgggaucaagcaagugggaaccacgcaggagaaaaagaucgaaaaguauuuuuggcggucugaggccgugaaaaagcagcuggauuucgaaucccuugcugucguuuuucaagagauuaacagcaaccugaauaacucuuccggcuaccucggggccaucagcgaccgcuccaaagaacuguacuucaauaaccagaccgugggagaguaucugcauugccagcucaaggagaauccccacacaaaacugaagaaccagguguuuuacagacaagauuaucuugacgaguucgaaaagauuugggaaauccagucuaaauaccauaccguccugacaaaggagcucaaagaagagauucgggacgugaucaucuucuaucagagaaagcugaaaagccagaagggccuuauuuccaucugugaguuugaaaaucgcgagauugaaaucaccgagaacggcaagauuaaaaagaaagagguugggcugaagguggcgccuaaaagcucucuccuguuccaagaauuuaagaucuggcagguccugaauaaccuccaguuccagaauaucgaguccaaagaaauuuuuccccuggaucuugacugcaaggagagcaucuucaacgaagugaauauuaagggacggaucucugccaaagcuguucuggaugugcucggcuacagcgggaaggaguggaaaacgaacuuuaaggacauugagggaaauaacuccaacgaaaaucuguauaacgccuaccugaaaaucauugcuaaugagggcaucgaguucccuaaggaauuuaaguguaaccuugaugacgauaucaaugucucuaaaauuaucugcagcgccgggaagauuaucgaguucgugagagaaaaauuuuccgagcucggaauuaacacaagcauccuggacuucaauucugaacuggagggcaccaacuuugaaaagcaaaaauccuaccagcucuggcaucugcuuuauagcuacgauggcgacgauucuccguccgggaaucagaagcuguaugagcuccuggaaaagaaauucggauucaagaaagagcacagcaucauucuggccgacaucggcuuuccccaggaguacgggucccuuucuacaaaggcuaugcgcaaaauuaucccucaccucaagaccggacugcccuucgcgaagaaaagcgacaacgauaccauucuguccgccacagcuauggccggcuauaaucacucuaagagccucacgaccgaggaacugacaaaacggguccuuaaggaacaucuggagauccucccuaaaaacucccugagaaaucccgugguugagaagauccugaaccaaaugauuaauguggucaacgaagugaucaaagaguacgggaagccggacgaaauucgcaucgagcuugcccgggaacucaagaaaaacgcugaggagagagccaauaugaccagcgaaauuggcaaggcgacaauccagcaccagaaauauucugagauccugcaaaaggaauuuggaauuaaauccccuagccgcaacgauaucauucgguacaagcuguaccucgagcugucuaauaacggcuucaaggaccuuuauaccgauauccagauuaaaagagaggaacuguuuacggacaaguacgauaucgaccauauuaucccccagucccgcuucuuugaugacagcuucucuaauaaaguucucgugccuagaggggcuaaccugaagaaaggaaaucugacagccuuugauuaucuugagagcgaaggcaaggacacccucgagaaguucaucaacaccauuacagaauuuuacgauaaagggaucauuaccaaggccaaauaugagaagcugcagaaaaagggaacagaaaucggcgacggguucauugagcgggaccugcgggauacgcaauacaucgcuaagaaagccaaggagauccucuuuggcauuaccaauuccgucgugagcacaucuggacgcaucaccgacaaacugagagaagauuggaaccuugugaauacaaugaaggagaugaaccuggaaaaauaucggaagagaggccucaccgagacgguuauuaauuccaagggggaggaaaaagagaagaucauugacuggagcaaacgcaacgaucaccggcaccaugcuauggacgcccugaccgucgcguucacaacccacaaucauauccaguaccugaacuaccuuaacgccagaaagaaugaagaucacaaacagcauaaggugaucuccaacauugagaaucugaucacaaaaguguucgaaaagaagaacggaucuaaacagcgcagauuucucgagcccauucacaauuuccggaucgacgcuaagaaacaccuggaggaaauucucaucagccauaaggccaaaaacaaggucgugaccaagaauauuaacaaaaucaagaaaaagggcuccaucauugcuaaaaucgagcugacgccccgcgggcaacuucacaaggaaacaauuuauggaucuagcaaguaccugaaaaccaaggaugagaaacucuccggcaaguuugaccuggaaacaaucaauaaaguucagaacgagagauauaagaaugcccugcuugagcggcugaagguguucggguacgauucuaaaaaggcguuuaccggcaaaaacauucucgccaagaauccuaucuuccugaacaucgaaaagaccgagcagcucccggaaguccugacacuugcuugguaugagacgauuuacaccauccgcaagagcauuaauuccgacaacuuuaaagauuauaagaauaucgacaaggugacagacaaaaagguucauaacauucugaccgauagacuccgggaguucaacggaaauagcaaagaagccuuuucugaccuggagaagaaccccaucuggcugaauaaaccuaagggcaucgcuauuaagacagugaccaucacgggggucaacaauguggaagcccuucacuacaaaaaggaucacuucggaaaagaguuucuggacgaaaagggccauaaaauucccguugauuucguguccacagggaacaaucaccaugucgccaucuacgaggacaccgcuggaaaccuccaggagcgcgugcugagcuucuaugaagcgguggagagagucaaucaaggccucucuguuauugauaaggaauacaacuccagccugggguggaaguuucuuuucaccaugaaacagaaugagauguuucuguuccacucugaagacuuuaacccucaggagaucgaucuguaugacgagaagaaucuccggcugauuuccaaaaaccuuuuccgcgugcaaaaguuuacagugaaagauuacuucuuuagacaucaccuggaaaccaaugucgaggacaacagcaagcucaagggcgacacauggaaacgggaaggacugaacggcaucagagggauccucaaggugcgccugaaucaccuuggaaaaauuguucaggugggcgaguauuga

SEQ ID NO: 4462 - RNA, 4215 nt, Artificial Sequence
  Cas9 variant
augagcaagaaaauccugggccucgaccuggggaccacauccauuggaugggccuucgugagagaggcugaagauuuucaggaggaaucuagcaucgagcggauuggcguccgcguuaacccccuuacgaccgacgaacaaaucaauuucgagaaggggaaaccuauuuccgugaacgccgauagaacacugaagcggggagcgcgcagaaaucuccagcgguacaaacagcgcagaaccaaccugauccagcuucugaagcaauauaagaucauuaaugagaacacaauccucgcugaagacgauaaaaauaccacacacucuaccuacgcccugcgggccaaggcugugagcgagaaaauuuccaaggaagccuuugcucgcguccugcucaugaucaacaaaaagagaggcuauaagucuagccggaaagccaagaaugaggacgaggggcaggcgauugauggaauguccguggccaaacgccuguacgaagaggacaucacgccgggccagcuuugccugcagcuccugaaggaaggcaaaaagaaacuucccgauuucuaucugagcgaccuccaagcugagcuggaaaagauuuggaacuuucagaagaaauucuacccugagauccugaccgaugaguuuaagaaagaaaucgaggggaagggacagagagccacaucugcuuccuucugggccaaauauaaguuuaauaccgcggaaaacaagggcagccgggacgagaaaaagaugcaggccugggaauggcgcucuaaagcuauuaauacacaacucaccagagaggagguugccuacgugaucacggaaauuaacaauaacaucaacaauuccagcggguaccugggagcuauuucugaucgguccaaggagcuuuauuucaacaaagaaacagucggcgaguaccuguuuagacagcuccgcuauagcccccauacccgggugaagaaucagguuuucuacagacaagacuaucuggacgaauuugagacaaucugggagaaccagucccgcuaccacaaugaacuuaccaacgagcugaagucugaaauccgggauguggucauuuucuaucagagaaaacucaagagccagaaagggcugaucuccuucugugaguuugagagcaagcaaauugaaauccagaaagacggaaagauugugaagaaaaucaucggccugaaggugucuccuaaauccagcccccucuuccaggaguuuaagauuuggcagauccugcaaaaucuugaguucaccaacaaagagacaaaggaaaagaaggucccugauuuugaggccaagaaucuccuguucgaggaacugaacauuaaaggcaaucuuaagggggagaaagccaucgaaauucugggauacaagccgaaagaguggcucguuaacuacaaggaacuggacggcaaucgcacgaaccaggugcuguaugagggguaccucaagauccuggagguggaaggauaugauauuaaagaccuucugaagaucaaaucuaauaaggaugaggucaaccucagcgaacuguccaaacccgugucugagaucaaggaccugauuaagagcaucuuugaaucccuuaacauuaauaccgcuauccucgauuucaacccugagcuggagggcaaagacuuugaacggcaggcgagcuaccagcuguggcaucuccuguauucuuacgagggggauaauuccaacacaggaaaugacgaacuuuauagacugcucuaccaaaaguucggcuuuggcaaagagcacgcccagauucuggcuaaccugagcuucucucaggacuacgggucccuuagcgccaaggccaugcgcaaaaucuaucccuuuaucaaggaaaauuccuacucugaggcuugcagccucgccggauauaaccauuccucuagcauuaccaaggaagaaaaugauaaacgggagcugaaggaaaaacuggagcuccugccuaagaacucccuuagaaaucccguuguggagaaaauccugaaccagauggucaaugugauuaacgcgaucauugcugacccgagcaugggccgcccugaugaaauccggaucgagcucgccagagaacugaagaaaaaugccgcugagcgggccgaaaugacaauucacaucaacaaggcuaagucugagcacgacaacuaccgcaaaauucugaccacggaguucgggauccccaauccuacaagaaacgauauuauccgguauaaacuuuacgaggaacucaaaguuaauggauauaagacccuguacuccaacaccuacauccccagagaaaaacuguucagcaaggaguuugacguggaacauauuauccccaaggcccuccuguucgaugacucuuuuuccaauaaaacaauuugugcgcgccaagagaaccuugauaagggcaauaaaaccgccuucgacuuuauccagagcuucuaugggaaggagaaauuugaagaguaccugcagcggauugaaucucucgcuaagaucaaggagggcgauacauucgucauuagcaaagccaaguauaaaaagcugcugcuuccugagaucgaaaucggagagggcuuuauugaaagagaccuccgcaacucccaauacaucgcuaaaaaggccaagagcaugcugcuggauauuugcaaaacgguggucccgaccacagggucuaucaccgacagacuccgggaggacuggggacugauuaauaucaugcaggaacuuaacuucgagaaguauaaaaagcugggccucaucgagaugguggagaaaaaggauggguccuuuaaggaacgcauuacagacuggaccaaaagaaaugaucaccggcaucacgcgauggacgcccugacgguugcuuucaccaagcacaaccauauccaguaccugaauuaucuuaacgcccgcaaaaaugaaaaccacaagaugcauggaaacgugauugcuaucgagcagaaagaaacagagcugcucgucgauagcgugggcaagagaaaacggaaguuuaagcugcccauuuccaauuuccgcgagguugccaaaaugcaccucgaaaacauccuggugucuuacaaggccaaaaauaaggucgcuaccaaaaacaagaauagauucaagaccaaaaacggggagaaggugaaaaucgaacuuacaccucggggccaacugcauaaggagacgguguacggaaaaaugaagaaguaugaaacaaaagaggagauuaucggcagcaaguuugacgaagcgaccauucucaaaguugccaaucuggagcagcgcaacgcucugcuucagagacugaaggaaaauaacaaugaucccaaaaaggccuucuccgggaagaacucucucaaaagcaauccucuguacuauggagucgacuccaagcccaucccggagcggauuaaaaucguguggcucgaggaugacuacacaauuagaaaggaaaucaccccugaucugaaaaucgacaaggugauugauaucggcauucgccggauccuugagaacagacuggccgaauuuaaugggaacgcuaaagaggccuucucuaaucucgaaaagaaccccauuuggcugaacgagggaaagcgcaucgcgaucaaacgggucaccauuagcggcgugaagaaugcugagacacugcacuauaaaaaggaccaccuugggcaugaaaugcuggacaaacagggcaagagaaucccuguugauuuuguguccacgggaaacaaucaccaugucgccauuuacaaggacgauaaaagcgaccuccaagagaaggugguuucuuucuaugaagccguggagcgcaucaaccaggaacugcccauuaucgauaaauccuuuaaucacgaccucggcuggcaguuccuguuuaccaugaagcagaacgaguacuucgucuuuccucgggauggguucgaccccuacgagaucgaucuucugaauccggacaacuauaaaauuaucagcccuaaucuguucagagugcaaaagauugcuacaaagaacuacguuuuuaaucaccaucucgaaaccaaagccguggauggagagcugcuuaagaccaaaaaggaccugucugacaucacauaucgcuucauucagacgcccgucaaccucaaaaauaucauuaaggugcggaucaaccacaucggccagauugugaagaucggggaauacuga

SEQ ID NO: 4463 - RNA, 4218 nt, Artificial Sequence
  Cas9 variant
augaagaccauccugggccucgaccuggggacaaacagcauuggaugggcccuugugaaagaggcugaaaauuccaacgagaagucugaaaucauuaaacugggcgucagaguuaauccccucacgguggaugagaagaccaacuucgaagccgggcggccucugagcacaaaugcggaccgcaccgcuaaaagauccgcccggcgcaaccuucagagauacaagcugcggcgcaagaaucucaucgaucugcugauuaaaaaccaacucaucgacaaggauacaccgcugaccgagaucggcaaaaauacaacccaccagacgcuugagcugagagccaaggcugcccgggaacgcauugagcucgaagaccuggcuagaguguuucuugccaucaacaaaaagcggggauaucgcucuagcagaaaggucaauaacgaggaggaagggcaggcgguggauggaauggccguugcuaaaaagcuguacgacgagaaucucacccccggccaguaugccuacgaacugcuguccaaaggcaagaaauaugugccugauuucuaccggucugaccuccaagcugaguuuaacgccauuugggaauaucagaagcaguucuacgcggauauccuggacgaugagcuuuacaaugcccugaaagggcagggacaacagaacagccgcaagagauuucucgcuauuaagggcgucuauacagccgagaacaaagggaagcgggacgacgugaaacugagacauuacaaguggcgcuccgaagcuaucagcaaaaagauuaauaucgaggaaguugccuaugugcuugucgagaucaacaaugaucugaacaagucuuccggauaccucggcgccauuagcgaccggucuaaagaacuguauuucaauaaggagaccgugggggagaaccuguggaaacagauccagaagaauccccacacaucccucaaaaaccaaguguuuuacagacaggauuaucuggacgaguucgagcagauuugggaaacccaagcucaguuucauccucagcuuacgcuggcgcucaaggagcagauccgcgaugucauuaucuucuaccaacggaagcugaaaagccagaagggacuucugucuuuuugccaguucgaauccugggagaucgagagaaaagacgaaaauggcaacguuauucucaauaagacaacccagcugcccaaacgccaaacagugggccggagaguggccccuaagagcuccccgcuguuucaggaguucaagaucuggcagaacauuaauaaccucgaagucaccaaaaucucugagggggcuagcaagaauaaaaaggagaccgaaacacuguccgaugacgagcgcaaacuucuguucgaagaacucaaccugcggggaaaccugagccagaaggaagugcuucaaauucucggccugaaagauaaggaguacaagacgaauuuuucugaggggcuggaaggaaacagaaccaaugccgcccucuucaacaucuaucagcagaucgcugagaaugaaggcuacggguuugacugguccaaaaagagcgcccaggagauuaaagaagaacugaaggcgguuuucccccaaaucggcauucaggcugauauccuugacuuuaacgccaaucuggacggaaaagaguucgaaaaccaggccucuuaucaacucuggcaucugcuguacagcgcugaggaagaugacaagauuaaugaggaagaucagaucauuuauggcaacuccgccgugucucuuaagaaaaagcucugugagaaauuuggguucacaccugaguacgcuaaguggaucgccaaugucagccugcaggacgauuauggaaaccuguccaccaaagcgaugcgcaagaucauucccuaccucaucgacggcaaugauuacagcgaagccugcgcucuggccggguauaaccacucuaauucccuuacaaaggaggaaaacgacaaccgggagcugcucgauaaacuggagcugcuuccuaagaauagccucagaaaccccgugguugagaaaauucugaaucagauggugaacgucgugaaucaagucaucgagaccuacggaaagccggacgaagugcggauugagcuggcucgcgaacucaaaaagucugccgagaagagagcggagaugacgaaauccaucaacgaagccacacggagaaaugaggauaucaagaaacugauuaccaaggacuuuggcaucccuaaccccaccaaaagcgauguugugcgcuaucggcuuugggaggaacuggcuccucucgccuacaaggacgucuucacagggaaacagauuaagaaggaagaccuguuuuccucuaaaaucgauauugagcacaucauccccaaggcucugcuuuucgacgauagcuuuuccaauaaaacccucguguucagagagacaaaccugaagaaagccgaccgcacggccuaugauuucauugaaucugacuacaaugcuacccuggaugacuauauccagagaguugagacacucuacaacaauaccaagggcacaauuagcaagggaaaacggaacaagcugcuuauggcgcagaaaaaucugcccgauggcuuuaucgaacgcgaccucagaaacucccaauacauugccaagaaagcuaaggccaugcuguaucagguguucaaggaugucaacgugaccagcgggucuaucacggaccggcugcgcgaggauugggaccuuaucaaugugaugaaagaacugaacuuuccuaaguacaaagcccucggacugaccgagauugaggaaagauaugacaucggccaggagaagacaaaacggguugaagucauuaccgauuggacaaagcgcaaugaccacagacaucacgcuaugaacgcccucaccguggcguucacgacauccagccauauccaguaccugaauuaucuuaacgcucggaagaaugagucucacaaagagcacaagaacauuaaagggaucgaaaauaagauuacccauaaacaaaaggauaagcgcaaauuuaucccgcccaugccuaacuucagagaggaagccaagaaacacaucgagacaauucugguguccaucaagaauaaaaacaaggucuacaccaaaaauauuaacaagaccaagaaaaagagcggacauaauacaaaagaacagcucacgccccggggccagcugcacaaggagaccguguaugggaaaucuaagagaccuaugagcaagcccacaaaaaucaacaagaauuuuucccuggagcaagcccagcuuauuaucaacguucaggaaaaagagcuggugcuccgccaucuggcucaguucgacaacaauccggccgucgcguuugauaccaagacacucaaaaagaugccucugcuuaagaacggcgaaccccugaaagaggugcucuguuucgaagagaucuuuaccauucggaaggacaucacgccugaucugaaaauugagaagguuguggacgagaaaaucaaggcuauucuggaacaaagaaagaaagauuucggaggcaaugccaaggaagccuuuagcgaccuugauaaaaaccccaucuggcugaauaagaaaaaggggaucugcauuaaacgcgucacaaucaccggagugucuaacgcugaggcccuccaccaccagaaggaccaucugggccgggaaauucucgacgauaaugggaacccuauccccgcugacuucguuuccaccggaaauaaccaccaucuggccguguaccuugauagcgagggcaagcugcaggacaauauugucuccuucuacgaggcgguggugagaacaucucaggggcugccggucguugauaaaggccucaacaaggaccugggauggaaauuucuuuucagccugaagcaaaaugaaauguuuguguucccuaacgaugacuuugauaucaaugacuucgaucuccuggacgauaaaaaggccgagcucauuuccaagcaccuguaucgcgugcagaaaaucucuaaggucagcgcuggcaacuccuuugugcgggacaucguuuucagacaccaucuugaaaccacagugaaagaggucaaggagcugaaagacauuucuuacauccagcucaagagccuggaagggcugcgcaacauuaagaaagugcggaucaaucacauuggaaagaucguucaggugggcgaguauuga

SEQ ID NO: 4464 - RNA, 4221 nt, Artificial Sequence
  Cas9 variant
auggagaagaaaaucauuggcaucgaccugggggugaccagcauuggaugggccuacgucaucgaagaugagaacggccacucccggauucucagaaucgggacacgcguuaauccccugacgaccgaggaacuuaagaacuucgaacagggaaaaccuaucacagagaccgcugagagaacacugaagcggucuaugcgcagaaaucuccaacgguauaaacagcgcagaaccaaccugauuaaugugcuucugaagaacaagcucaucacagaaaccacggcccuggcggaggacggcaaagggaccacacaucugacccacgcucuccgggccaaggccgcuuacgcccagauuccgcuggaagauuuugcucgcgugcuucugaugcucaauaaaaagagaggauaucggagcucccgcaaagucaagacagaggccgacggccaggcgaucgauggcauggccguggcuaagaaacuguacgaggaaaacauuacccccgggcaacuuugcuauacgcugcuccugcagggaaagaaaacacugccugacuucuacagaucugaucuccagguugagauggaaaagguguggaccuuucagaaacaauuccaucaggccauccugacagacgaguuucggaaguauauugcuggcaaagggcagcgcgccaccgcggccagcuucuggggaaaguacggcuuuaauaccgcugaguucaagggguccagagaagagaaaaagcugaaaucuuacgaauggcggagccaggccaucacaacgccccuuucccaagaggaagucgcugccgugaucaccgauauuaacagcaauaucgccaacucuuccggauaucucggcgcuauuagcgacagaucuaaggagcuguuuuucaauaaacagacaguuggccaguaccaauauaaccuucugcagcagaauccucacaccaaccucuccggacagguguuuuaccgccaagauuaucuggacgaguucgaaacaaucugggagacccaggcgacguuucauacaaugcugacccccagccucaaggaagagauucgggauaucgucaucuucuaccagagaaagcugaaaucucagaagaaacuuguguccauuugugaguucgaaaagcgcauccuggaaccucuccaaggggacaaaguggucggcuauaagguugcccccaagagcuccccgcuguuucaggaguucaaaauuuggcaggcucuugggcggauggagauccagcacaaggugaccaaagaaagacacuuucuggaccucgaugccaagcaacugcuguucgacgagcucaacgugaaaggagaucugacaaaggaaaaugcccuuaccauucugggcuuuaagccuaaagagugggagugcaaccuccugaagcuggaagggaaucgcacaaaccaggcucuuuacgaggccuaccucaaaauccuggaacuggagggauaugaagucaaggaccuccugggccuuaaacuggauaaggacgauaucaaacucucugagcugcccguggacgcggcugauauuaagaagaugguucgggagaucuucgaaacgcugaauauuaaaaccagccuucucgacuuuaacgccacacugccuggcaaguccuucgagcagcagcaugccuaccaacuguggcaccuccuguauagcuacgaaggggauaauucucccuccggaaacaaaaagcugcaggaccuucuccaggcuaaauuuggcuucaccaaugcccaugggcaaauccuggcuaacgugagccuggagacagacuauggaucucuuagcgccaaggcgauuagaaagaucuuuacccacauuaaagaaaaucacuacuccgccgcuugugcccucgcuggcuauaaccauucuagcuaccuguccaaggaggagaaugaacagcgcauccugaaagaucggcucacgauccugccgaagaacagccuuagaaauccugucguggagaaaauucugaaccagcucaucaaccugcugaauaccauuuucgacgaucccuaccuugggaagccugacgaaauccgcauugagcucgcccgggaacugaagaaaaacguucaggagagacaacggcugaauacagagaucaccaagaacaauacagaacacgagcgcaucaccaaaauucucaucaaggaagauaacauuaaaaaucccacgagaaacgacaucauucgguauaagcuguaccaggagcuuaagcauaauggcuauaaaacacuguacucuaacaccuauauccccagagaggaacucuuuggaaagaauuucgauaucgagcacauuaucccucaguccauucuguucgacgauagcuuuucuaacaaaacacugugcgugcgcaaggaaaauaucgacaaagcggaucggaccgccauggacuucauuggcccguacuuuggggaggauaagguccaggaauauaucaacagaguggagaugcuucaucaaaucaaucugaaaaaccccgaggaaggaauuggcaaggggaaguacaaaaagcuccugaugaaggcuuccgagaucggacagggcuucauugaacgcgaccucagagacacccaguacaucgccaagaaagcucggcagaugcugcuugaggucacacgcacggugguugccaccacagggagcauuaccaagagacugcgggaagauuggggccucgugaacgucaugcaagagcugaauauggacaaguaucgccagcagggacugacagagcuuaucgaaaagaaggauggcuccaccaaagagagaauuacggacuggacaaagcggaacgaucaccgccaccaugccauggacgcucugaccaucgcguuuaccaaacacucucauauccaauaccucaauaaccugaaugccagaaagagcgaugacaagaaagggaaggaaauuuucggaaucgagcagaaagaaacagagaaggugaaagaugacaccggccagacacagcggcgcuuuaagcucccuaugcccgauuucagacaagcugccaagcaccaccuggagcaucuucugauuuccuuuaaagccaagaacaaaguuuucacgaagaauaaaaacaaguauaagaccaaaaauggggaacaggugaagcucgagcugacaccucggggacagcugcacaaagaaaccaucuacggcagaauuaagaaauaugucacacaugaggagaaggugucuagcaaauuuaacgcucagcuuauccaaaccguggccaauuccaaguaccgcuaugcgcugcucaagcggcuggaagagaacgggaaugaccccaaaaaggcuuucacgggcaaaaacagccucgauaagaccccgcuguuuguugacgccacacagcaggagaaaaucccucccgucgugaaacuugugucuauugaacagggauacaccaucagaaaggacauuacaccugaaaauuucaaagaugccaaguccaucgagaaaauugucgacgugggcauccgcaaccugcugcaccaucggcucgagaccuacaacgggaaugaaaaggaggcuuucuauaaccuggauaaaaaucccaucuggguuaacgaaagcaagggaauuuguaucaagagagugacaauuaccggcgucacgaaugccgagccucuucacuacaaacgcgaccaccaugggaagcccauccuggauaacaauggaaaccggacaccggcggacuuugugucuaccggcaauaaccaccaugcugccauuuauagagaugccgcugggaaucuccaagacaacguuguguccuucuacgaagccgucgcucgcgugaaucagggccugccuaucauugauaaaagccucaacaaggagcugggauggcaguuucuuuucucucugaaacagaaugagugcuuuguuuuccccaacgaaggcuuugacccccuggagaucgaucucuauaauccugccaacaacaagcugaucgcggccaaucuuuuccgggugcaaaacuuuagcagacugcaguacgggaauaacauuauccgggacuauaauuuccgccacauuuacgaaaccuccgucgagaacagaaaggaacucaaagacaucgcuuacaaacaggugaaaagccugccgauuuuugagaagaucaucaaagugcggauuaaucauaucggacaaauugucaagacaggcgaguauuga

SEQ ID NO: 4465 - RNA, 4224 nt, Artificial Sequence
  Cas9 variant
augaucagaaacauucugggccucgaccugggggugagcuccaucggaugggccuacguccaggaggauucuaagaauagcgaaaacaaucggauuaucaaacuuggcguucgcgugaacccccugaccguggacgagcaacucaauuucgaaaaggggaaaccuauuacaacgaacgcuggaagaacccuggcccgguccgcgcgcagaaaucuucagcgguuuaagcugcgcagaucuaaccucauggauguccugaaaaagaauaacauccugaaggagacagaccuccuggcugaagugggcaaaaauagcaccuuccagacacaggagcuucgggccaaguccgccaaagagaagaucgaacugucugaguuugcucgcguucuccugcuuauuaacaaaaagagaggguauaagagcucccggaaagccaagaaugaugaagacggacaaaucguggauggcauggcugucgccaaaaagcuguucgaggagaaccucaccccgggcgaauacagcuaucagcugcugcagcaggggaaaaagcaacuccccgacuuuuaccgcucugaucugcaggcggaguucgacaaaauuugggauuuucagaagcaguucaauccugaaaucuuuacaaacgagcuuuaugaaaagcugcaaggaaagaacagaaaugccaccuggaaggagcucgaguuccccuuuucccuggugggcauuaaacagacggggaccaugcaggaaaagaaaguugagaaguacuucuggcggagcgaagcugugaagaaacaacuugacuuugagucucuggccgucguguuccaggaaaucaacuccaaucucaacaauagcucuggauaucugggcgcuauuuccgaucgcagcaaggagcuguacuucuacaaccagacagugggggaguaucucuuucagcaacugaaaaccaauccucacacaaaacuuaaaaaccaggucuucuacagacaggacuaucuggacgaauuugagaagaucugggaaacccaguccaaguaccauaaagagcucacgaaggaacugaaagaggagauccgggauauuacaaucuucuaucaaagaaaacuuaaaucucagaagggacugauuagcaucugcgaauuugagaaucgcgaaauugagaucaccgagaacggcaagaccaaaaagaaaaccguuggccucaagguggcccccaaauccagcccucuguuccaggaauuuaagaucuggcaagugcugaauaaccuccaguuccagaauauugagaccaaagaagucuuuccgaucgaccuggauuucaagcagucuauuuuugacgaggugaacaucaaggggaaacuuuccgcgaaggauguucuggaccucgugggauacagcggcaaagaauggaagacaaauuucaaagagauugaggggaacuauacgaacgaaaaucuguacaccgccuuucugaagaucaucgcuucuaaggagauugaauuucccaaagaguucaagaucacaauugaugacgaaaucaaagucagcaagauuaacgccuccgcugagaucauuaaacuuuucgugcgggagaaguucucugaacucggaaucgauaccagcauccuggacuuuaauccugagcuggaaggcuccgauuucgagaagcaggccagcuaccaacucuggcaucugcuuuauucuuacgaaggggacgacuccagcucuggaaacgagaaacuguaugagcuccuggaaaauaaguuuggcuucaaaaaggagaacuccaaaauucuggccgaaaucggcuuuagccaggauuacgggucccuuucuagcaaggcuaugagaaagauuuaucccuacaucaaagagcacaaguauuccguugcguguucuuacgccggauacaaucacagcaaaaacucccucacaaaggagcagcuggaaaaucgcauucugaaagagcggcucgacauccugccuaagaacagccuuagaaaucccguggucgaaaagauccugaaccaaaugauuaaucucgugaacugccugaucgaugaguauucugaaaaggacaaggauggccagauugucaaauacuucaaguuugacgagauccgcauugagcuggcucgggaacuuaaacucaaugccgaggaaagagccaccaugacguccgagaucaacaaggcuacaauccagcaucagaaauaugccgaagugcugcaacgcgaguucgggcugaaggcgccgagccggaacgauauuaucagauacaagcucuaucuggagcuugcuaauaacggauuuaaagaccuguacaccgaugccaagauugaacgcgagaaucucuucaccgacaaauaugauaucgaccacauuaucccucagucucgguuuuucgaugacuccuucagcaacaagguucuggugcccagaaaugccaaccugaaaaagggcaauuuuacagcuuucgacuaccuugaaaucgaggggaaggaaaaacucgagaaguuucugaacauuaucaaagaucuguacgacaagggcgccauuaccaaagcuaaguaugagaagcuccagaaaaaggauuucgaaaucggagacggcuuuauugagcgggaucugcgcaauacacaguacaucgccaaaaagucuaaagaaauucuuuucgggaucacgaacagcgucgugaccacauccggaagaaucaccgacaagcugcgggaggauuggaaucucauuaacacaaugaaggagcugaaucuggaaaaauauagaaaacuuggccugaccgagacgguuaucaacagcaaaggggaagagaagcaacgcauuaucgacuggaccaaacggaaugaucacagacaucacgcgauggacgcccucacaguggcuuuuaccacacauaaccacauucaguaccugaacuaucucaaugcccgcaaggaugaaaaacacaaggagcaucagaacaucuucgcuaucgagaaucugauuaccgaaaucauugacaagaaaaacggaucuaaggagagacgguuuaaagaaccugucaagaaucuucgcgccgaggcgagaaaacaccuggaugaaauccucauuucccauaaggugaagaacaaagugguuacgaagaauaucaacaaaaucaagaaaaagggcagcgucauugccaagacagagcugacaccccgggggcagcugcacaaagagacaaucuacggcuccucuaaguuccuuaaaaccaaggaagagaaaauuagcggaaaguuugacguggaaaccauccaaaaggugcagaaugagcgcuauagaaacgcucugcucaaacggcugcaggaguucggcggggacuccaagaaagccuucacaggaaagaaugucauuucuaaaaaccccaucuuucucaauaacgaaaagacggagcaacugccugaaaccgugacacuugcuugguacgagaugggcuacaccauucgcaaagccguuaauccggauaacuucaaggacuuuaagaauaucgaaaagacaaucgauaaggggauuagagacauccugaccaaacggcucaaggaguucaacggaaacagcaaagaggccuuuuccgaucuggacaagaaucccauuuggcugaacaagucuaaaggcaucagcauuaaggcugugacgaucacagggaucaauaacgcggaagcccuucauuauaaaaaggaucaccugggcaaagacuuccucgaugagaauggaaagcgcauugcugucgacuuuguguccaccggcaacaaucaccauguugccaucuacgaagaugagaacgggaaucugcaggaaaagguggucagcuucuaugaggccguggagagaguuaaccagaaucucccuauuaucgacaaagaauacaacucugaguccggauggaaguuucuguucaccaugaaacagaaugaaauguuucuuuuccccagcgaggacuuuaacccuaaggaaauggaucuguucgacgagaaaaaugugaaccugauuucuaagaaccucuuccggguccaaaaguuuacaaucaaagauuauuucuuuagacaccaucuggagaccaauguggaagacuccagcccccuuaagggcaucacauggaaacgcgaggggcugaacggaauugaaaauauccucaaggugcggcugaaccaccucggcaaaauuguccagaucggggaguacuga

SEQ ID NO: 4466 - RNA, 4227 nt, Artificial Sequence
  Cas9 variant
augaccaagaacauccugggccucgacgugggggucagcuccauuggaugggcccugaucaaugaggauauugaaaaccccaaaaauaacaagaucauuaaacuuggcguuagagugaauccucugacaguggacgagcagaucaacuucgaaaaggggaaaccgaucacgaccaaugcuggacggacacucgcccgcggcgcgagacggaaccugcaacgcuuuaaacuuagacgguuccaccugauugauauccuccagaagaauaacauucugaaacaggcugaccugcucgccgaggucgggaaaaauucuaccuuucagacacaagaaauccgcgccaagagcgcuaagcagaaaguggagcuguccgagcuugccagaauuuuccugcucaucaacaagaagcggggauacaaaucuagccgcaaggcuaaaaaugaagaugagggccagauuaucgacggcauguuuaucgccaagaaacuguaugaugaaaaacuuacccccggggaguacuccuaucagcugcucaaggagucuaagaagcaacugccugacuucuacagaagcgaucugcaguccgaauuugacaaaauuuggaacuuccagaagcaguuuuaucccgagaauuucagcgauaaccucuacaaagaacugcaaggaaagaacaaaaaugcgacauggaagacccuugagaucccuuuuucucugguuggcauuaagcagacggggacccuccaggaaaagaagcuggagaaauauuccuggcggagcgacgccgugaagaaacaacuugauuacgagaagcuggcugucguguuccaggaaaucaacucuaauauuuacaacuccagcggauaucucggcgccaucucugaccgcuccaaggagcuguacuuuaauaaccagacaguuggggaauaucuguacaaucagaucaaagagaacccccauaccaagcucaaaaaucaaguguucuauagacaggacuaccuggaugaguucgaaaagauuugggagacacagagcaaauaucacaccacgcuuacaaaggaacugaaggaggaaauccgggacauuaucaucuuuuaccagcgcaaacucaagucccaaaaaggacugauuucuaucugcgaguucgaaaacagagagauugagaucaaggaaaauggcaaaauuaagaaaaagaccgucggccuuaagguggcuccuaaaagcuccccgcuguuucaggaguucaagaucuggcagauucucaacaaucugcaguuucaaaacaucgaaagcaaagagauuuuccccaucgaucuggacuuuaaggagucuaucuucaaugaagugaacauuaaagggcggaucuccgccaaggcgguccucgaucugcuuggauacagcggcaaggaguggaacccuaauuuuaaagacauugaagggaacaauacaaacgagaaucuguauaacgccuaccucaagaucauugcugaugaagaguucgagcugcccaaagaauuuaagcugaauggagacgaugaccuuuauguuucuaaaaucgccuguagcgcuuccaagaucaaggauuucgugaaagagaaguuuucugaaauuggcaucaacaccagcauucucgacuucaauccugagcuggaagggaaagacuucgagaagcaggccuccuaccaguuuuggcaucugcucuauagcuacgagggagaugacucucaguccggcaacgaaaaacuguaugagcuucuggaaaagaaguucggcuuuaaaaaggagcacagcaaaauccucucuaauauuggguucccccuggauuacggaaaccuguccaccaaggccaugagaaaaaucaucccgcaucuuaaggcuggccucagcuuugcgaaaaaguccaaggaagacaauauucugucugccacagcuauggccggguacaaccacagcaauuccuauacgaaagaggaucuggccaagcgcgugcucaaagagaagcuggaagucuucccuaaaaacucucuucggaaccccgugguugagaagauccugaaucaaaugauuaaccucgugaaugaagcugucgaggaguacggaaccaucgacgaagugagaauugagcuggcccgcgaacugaagaaaaacgcggaggaacgggcuaauaugacaagcgagaucggcaaggccacccuucuccaccagaaauaugccgagauccugaagaaagaauuugauauuccuguucccuccagaaacgacaucauucgcuacaagcuguaucucgagcuggcuaauaacggguacaaggaucuuuauacagacgugcagaucaaacgggaggaacuguucaccaauaaguacgauauugaccauaucauuccccaaagcagauuuuucgaugacucuuuuuccaacaaaguccucgugccucgcggcgccaaucugaagaaagcuaaccagacggccuucgacuaccuggaaaaugaggauaagcagaaacuugagaaguuucucaacaucaucaagaaucuguaugacaaaggagaaauuacaaaggcgaaauacgagaagcugcagaagaaaggcagcgauaucggggaaggauucauugagcgggaccucagagauacccaauauaucgccaagaaagcuaaggaaauucuguucggcaucacccacucugucaucuccacaagcgggaaaauuaccgacaaacuucgcgaggauuggaaccuggugaacacaaugaaggagcucaaucuggacaaguacaagaaacugggacuuacggaaacccugcucaacucuaagggcgaggaaaaagagcggaucauugauuggagcaagagaaaugaccaucggcaccacgccauggaugcucugacaguugccuuuaccacacauaaccacauccaguaucucaauuaccugaacgcgcgcaaagacgaggaucauaagcagcacaaggugauuuccaauaucgaaaaccuuaucaccaaagucuucgagaagaaaaauggggccaagcagagacgguuuauugaaccgaucaacaauuucagaguggacgcuaaaaagcaucuggacgagauucucaucagccacaaggccaaaaacaagguugugacgaaaaauauuaacaagaucaaaaagaagggcucugucguggcuaaaaccgaacugacaccccgcggacaacugcacaaggagaccauuuauggcuccagcaaauuucuuaagacaaaagaugagaagaucuccgggaaauucgaccuggaaaccaucaauaaggugcagaacgagaaguacaaaaaugcccuccugcagcggcucagagaauuuggagaggauucuaagaaagccuucacgggcaagaacguuauuagcaaaaacccuaucuaccuggacgaagagaagacacuucagauucccgaguccgucacccuggcuugguaugaaaugaucuacacaauucgcaagccugugaaucccgauaacuuuaaagacuauaagaauaucgauaaagugaccgacgagaagaucagagcgguccucaccgaucggcugcgcaaauucaacggaaauucuaaggaagccuuuagcgaccuggagaagaacccgauuuggcuuaauaaauccaaggggaucgcuauuaaaacagugacgaucaccggcaugucuaacguugaagcccugcauuacaagaaagaucaccucgggaaggagauucuggacaagaaaggcgacagaaugccuguggauuucgucagcacaggaaauaaccaucacgccgcuaucuaugaggacgccaagggcaaucuccaagaacgggugguuuccuucuacgaggcgguggaacgcgucaaccaggggcugagcgugguuaauaaagauuauaacgcuggacuuggcuggaaguuucuguucaccaugaaacagaaugagauguuucuguuccccucugaggacuuuaacccuaaggaaaucgaucucuacgacgagaaaaaccugaaacuuauugccaagaaucuguucagagugcaaaaguuuggggaacucuccaagagcggauucugguuucggcaccaucuggagacaucugucgaugugaaaaaggaacuccgcaacuacuccuaucuggacuucuacagcaaagauuuuaugaagaccaucgugaaggucagacuuaaucaccugggcaaaauuguucaggugggggaguauuga

SEQ ID NO: 4467 - RNA, 4230 nt, Artificial Sequence
  Cas9 variant
augagcaucauuaacuuccagagacggggccugauggagacccaagccuccaaucagcucaucucuagccaccugaagggguaccccauuaaagacuauuuugugggacuugauaucggcacauccucugucgggugggcuguuacgaacaaggccuacgaacugcucaaauuccgcagccauaagauguggggauccagacuguuugacgagggcgaaucugcgguggcucggcgcggguucagaagcaugcggcgcagacuugagcggcgcaaacugagacucaagcugcuggaagaacucuuugccgaugccauggcucagguggacccuaccuucuuuaugcggcugcgcgaguccaaguaucacuacgaagauaaaacaaccggacauagcucuaagcacauucuuuucaucgacaaaaauuauacagaucaggacuacuauaaggccuacccgaccaucuaccaucugagagcugagcucaugaaagauggcacagacgauauucggaagcuguuucuugccguccaccacauccugaaguaucgcggcaacuuccucuacgaaggggcgaccuuugacuccaaugccagcacgcuggaugacgugauuaaacaagcucuggagaacaucaccuucaauugcuuugacuguaacucugccauuuccagcaucggacagauucucauggaggcuggcaagacaaaaucugauaaggccaaagcgaucgaacaucugguugacaccuauaucgccacagauaccguggacacguccagcaagacacagaaagaucaggucaaggaggacaagaaaagacuuaaggcuuucgccaaucuggugcucgggcugaacgcuucccuuauugaucuguucggaucuguugaggagcucgaagaggaccugaaaaagcugcaaaucaccggcgauacauacgacgauaaacgggacgagcucgccaaggccuggagcgacgaaauuuauaucauugaugacugcaaguccguguacgaugcuaucauccugcuuagcauuaaagagcccgggcugaccaucucugaauccaaggucaaagcguuuaauaagcacaaagacgaucucgccauucuuaagagccuucugaagucugacagaagcaucuauaacaccauguucaaaguggaugagaagggacuccauaauuacgugcacuacauuaaacagggccgcacagaagagacguccuguaaccgggaggacuuuuauaaguacaccaaaaaggucguugaaggccugccugauucuaaggacaaagaguauauccugagcgaaaucgagcuccagacacugcuuccccugcagagaauuaaggauaauggggugaucccuuaccaacuccaccuggaggaacugaaagugauucuugcuaagugcggacccaaauucccuuuucucaacgaggucgccgacggcuucuccguggccgaaaagcugaucaaaaugcuggaguuucgcauuccguauuacguugggccccucaacacccaucacaauguggauaacggaggcuucgcuugggccguccggaaggcgagcgggagagugacaccuuggaauuuugacgacaagaucgaucgcgaaaaaucugcugccgccuucauuaagaaccugaccaauaaauguacguaucuucugggagaggacguucuccccaaguccagccugcuguacucugaguuuaugcuucucaacgaacugaauaacgugcggaucgauggcaaaccucuggagaaggcugucaaggaacaucucaucgaggccguguucaaacaggaccacaagaaaaugacaaagaauagaauugaacaguuucugaaagauaacaauuacauccccgagaagcauaagccggagauuaccggccuugacggggaaaucaaaaacgaucuggcuuccuaucgcgacaugguccggauucucggaaauaacuucgaucugagcauggccgaggaaaucaucaccgacauuacaaucuucggcgaguccaagaaaaugcugagagaaacccuucgcaauaaguuuucuagccggcucgaugacgaggcgauuaaaaagcuguccaagcugagauaccgggauugggggcgccucucuagaaaacugcuuaacgugaucgagggaugcgacaaggccggcgacgggacaccugaaacgauuaucauccugaugcggaacuucagcuauaaucucauggagcugcugggcgauaaauuuuccuucauggaacgcauucaagagaucaacgcuaagcugauugaaggacagaucguuaauccccacgacauuaucgaugaccucgcccugagcccugcugugaaaagagccgucuggcaggcgcugcggaucguggaugagauuguucacaucaagaaaacccuccccgccagaauuuuuguggaggucacacgcucuaacaaggcugaaaagaaaaagaaagacuccagacagaagcggcugagcgaucuuuacgccgcuaucaaaaaggacgaugcccugcucucuggccugaccaaugaggaguucgggggacugaaguccggccuugccaaauaugacgaugcugcgcugcgcagcaagaaacucuaccuguauuacacacaaauggggagaugugccuacaccggagaagugauugaccucucucagcugaacacggacaauuaugauaucgaccauauuuacccccggagccuuaccaaggaugacuccuuugauaaccuggugcucugcaaacgcacagcuaaugcccaaaagagcgacaccuauccuaucucuaaggagauccagaaagcccagaaggcuuucuggauuuuucugaaacagcagggccugaucuccgaaagaaaguacgagcggcuuacacgcauuaccccgcugacggccgaugaccucagcggguucaucgcgagacagcugguugaaacaaaccaauccgucaaagcugccaccacacuccugcggcgccuuuaucccggcguggauguggucuuugugaaggccgagaauguuaccgacuucagacacgauaacgacuuuauuaaggugcggucucugaaucaucaccaccaugcuaaagaugccuaccucaacaucgucgugggaaauguuuaucacgaaagauucacccgcaacuuccgggcguuuuucaagaaaaacggcgcuaauagaacauacaaccuggccaagauguuuaauuacgacgugaacuguacgaaugccaaagacgggaaggcuugggaugucaagaccagcauggacacagugaaaaagaugauggccuccaacgauguucgcgugaccaaacggcugcuugagcagucuggagcucuggccgacgcgacagucuauaaggccgcuguggccgagaaagcuaaggauggcgccuacaucgggaugaaaaccaagagcuccguguucgccgacgucucuaaguauggaggcaugacgaaaauuaagaaugcuuacagcaucauuguucaguaugcggggaaaaagggcgaaguggugaaagagaucgucccucuccccauuuaccugacaaacagaaauaccaccgaucaggaccucaucgauuauguggccuccaucauuccucaagcuaaggacaucagcauuaucuaccgcaagcugugcauuaaccagcuuguuaaagugaauggauuuuacuauuaccugggcgggaagacaaacucuaaauucuguaucgauaaugccauucaggucaucguguccaacgaauggauccccuaucugaagguucucgagaaauuuaauaacaugcggaaggacaacaaggaucugaaagccaaugugauuagcaccagagcucuugacaacaagcauacaaucgaaguccgcauuguggaggagaaaaauaucgaguucuuugacuaccugguuucuaagcucaaaaugccgauuuaucaaaagaugaagggaaacaaagccgcggaacuguccgaaaagggcuacggacucuucaaaaagaugagccuggaggaacagucuauccaccuuaucgagcugcugaaucuccugacgaaccagaaaaccacauuugaggugaagccucuugggauuaccgcuucccggagcacagucggcuccaaaaucagcaaucaggaugaguucaaggugauuaacgaaucuaucaccgggcuguauagcaaugaagugacgauugucuga

SEQ ID NO: 4468 - RNA, 4233 nt, Artificial Sequence
  Cas9 variant
augaccaagaacauccugggccucgaccugggggugagcuccauuggaugggcccuuguccaggaaaauucuaaaaaccccgaaaauaacaagaucguuaaacugggcgugagagugaauccucucacagucgaugagcaaauuaacuucgaaaaggggaaaccgaucacgaccaaugcuagccggacacuggcccgcuccgcgagacggaaccuucagcgcuuuaagcugagacgggcuaaucucauugacgugcugaagaaaggaaacauccugaagcagggcgaucuccugaccgagaucgggaaaaauucuacauuccagacccaagaacuucgcgccaagagcgccaaagagaagguugagcuguccgacuuugugcggauucuccugcuuaucaacaagaaaagaggauacaagucuagccgcaaagcuaagaaugaagaugagggccagauuaucgacggcauggccgucgcuaaaaagcuguaugaagagaacauuacacccggggaguacuccuauaaacuccugcaggaaggaagaaagcagcugccugauuucuaccggagcgaccuccaagccgaguuugauaagaucuggaauuuccagaaacaguuuaaccccgaaauuuucaccaacgagcuguauaagcgccuucagggcaaaaauagaaacgcgacguggaaggaacuggagaucccuuuuuaccucguggggaucaaacaaauuggaaccaugcaggagaagaagaucgaacgguauuucuggcgcucugaggccguuaaaaagcagcuggacuuugaaucccuugcuguggucuuccaagagauuaauagcaaccugaauaacucuuccggcuaccucggggccaucagcgauagaucuaaagaacuguacuuuaauaaccagacagugggagaguaucuguacaaucagcucaagauuaacccccacaccaaacugaagaaucagguguucuaucggcaagacuaccuugaugaguucgaaaagaucugggagacacaggcuaaauaucauaagaaacugaccaaggaacucaaagaggaaaucagagacauugucaucuuuuaccagcgcaagcugaagucccagaaaggccuuauuagcuucugcgaguuugagaaccgggaaaucgagauuacgguuaauggcaagacaaagaagaaaaccguggggcugaagguggucccuagauccucuccccucuuccaagaauuuaaaaucuggcagcgccugaacgaccuggaguucaagaauguggagacaaaggaaaucuuuccgcucgagcuggaacacaaagagauucuuuucggaaaccugaacaucaagggcaaucucagcuccaaagaacugauugagcagcugggguauccuagcaaggaguggaaauguaacuuuaaggaaaucgauggaaauaagacccaugagaaccuuuacaccgccuuccucaaaauuaucgcgaaugaaggcauugaguuucccaaggaguucaaacugucuaucgacgaugacaucaagguuuccaaaauugaugugagcucugagaagaucaaggaguuuauuaaagaaaacuuccugaagcucgggaucaauacaagcauucuggacuucaacccugagcuugauggaaaagacuuugaaaagcaggaguccuaccaacuguggcaccuccuguauucuuacgaaggcgaugacagcgccuccggcaaugagaaacuguaugagcuucucgaaaagaaguucggguuuaaacgggaguacagcaagauccuggcugaugucggauucucucaggacuauggcucccugagcucuaaagccaugagaaagaucuuuacguacauuaaagaaaacaaguauuccgaggcuugccaucucgccggguacaaucacagcaaaaacucccugaccaaggagcagcuugccaaucgcauccugaaggaacagcucgagauucugcccaaaaacgcucugcggaauccggugguugaaaagauccuuaaccaaaugauuaaccucgugaaugaggucaucaaagaauacggaaagccugacgagaucagaauugagcuggcgcgcgaacugaaaaagaacgccgaggaacgggcuaauaugacaucugauaucagcaaggccacccuccugcaccagaaauaugccgaggugcuucagaaggaguucggcauuaaagcucccuccagaaacgacaucauucgcuacaagcuguaucucgaacuggccaauaacggguacaaagaucuguauacaaaucaaaagaucgagaaggaaaacaucuuuaccgacaaauacgauauugaccauaucauuccucagucucgguucuuugaugacagcuucuccaauaagguccuugugcccagaugugcgaaccaggauaaagacaauuauacggcuguugauuacaucgagaagaaauacggcgaacggggaaaggaggacuuucucaaccgcauucaccugguguucaagagcaaagaagccaucgccggcaagucugagucccagauuagcucuaugaauacaaaauuucugaagcuccagaaaaagggguccgagaucggagaaggcuucaucgagagagaucugcgggacacccaauauauugcuaagaaagccaaggaaauccuuuucgggauuaccaacagcgucaucucuacaagcggaagaauuaccgacaaacugcgcgaggauuggaaucucgugaacacaaugaaggagcugaaccuggaaaaauaccggaaacuuggccugacggagcucaucgcuaauuccaaaggggaagagaaggaaagaaucauugacuggaccaagcgcaacgaucauagacaccacgccauggacgcgcugacaguugccuuuaccacacauaaucacauccaguaucucaacuaccugaaugcucggaaagaugagaagcauaaagagcaccauaacauuuucgccaucgaaaauauuaucaccgagaucguggaaaagaaaaacggcagcaaggagcgcagauuuaaacuucccauuaaaaauuuccggacggaagcuaagaaacagcuggaggagguccucaucucucacaaggccaaaaacaagguggugaccaagaauauuaacaaaacaaagaaaaagggaggcguugucuccaaaaucgugcugaccccucgcgggcaacugcacaaggaaacaauuuauggaagcgcgaaguuucuuaaaaccaaggaggagaaaaucuccggcaaguucgaccuggaaacgauuaauaaagugcagaacgaaaaguuuaaaaaugcccuccuggauagacucaaggaguucaacggggacucuaagaaggcuuuuacaggaaagaaugucccggccaaaaaccccaucuaccugaacgagcagaagaccgaacaggugccugagagcguugugcuugcuugguaugaaacaggcuacaccauccggaaagccgucaaugccgauaacuucaaggacuacaagaaucuggagaaaauuaucgauaagggggugaaagagauucucaagaaccgccugaaugcuuuuaacggcaaugcgaaagaagccuucuccgaccuggagaagaagcccaucuggcuuaaccaaucuaaaggaauugcuguuaagaccgugacaaucacgggcaucaauaacgccgaaacccugcauuauaaaaaggaucacuucgggaaugagcuccuggacgaaaacggcaaaaagauuccugucgacuuugugagcacaggaaauaaccaucacguugccaucuacgaggaugcugacgggaaucuccaggagagaguggucuccuucuaugaagccguggagcgggugaaccagggacugucuauuaucgauaaggaauacaaccaagaccuuggcuggaaauuucuguucaccaugaagcagaaugagauguuucuguuccccagcgaagauuuuaacccgaaagagacagaccucuucgaugagaagaaucugaaccuuauuuccaaaaauauguuucgcguccagaaguucgggagccugcucucuggcuuuugguucagacaccaucuggaaaccacgguugaccucaacuccagccugaaagauacaucuuauaaggugauccaguccugcaauaaccuuaagcugaucgugaaaguccggcugaaucaccucggaaagauugugcaaaucggcgaguacuga

SEQ ID NO: 4469 - RNA, 4236 nt, Artificial Sequence
  Cas9 variant
auggugaagaaagaguacuucaucggccuggacauggggaccagcuccgucggaugggccguugcugauacaaacuauaaucuccugagagccaagggcaaagacauguggggagugcggcuuuuucccgaagcgucuacggcugccgaucgcagaagccaccggaccgcccgcagaaacaauaagcggaaagcugcccgcgagggguuccugagagaaauuuuugaggacgaaaucaacaagauugauccuggcuucuuugagcggcucaaggaguccaaauacuaucuggaagacaaacuuacagauaccccguucgugcuguuugcugacaaaggguacacagauaaggaguauuacgacgaauaucccaccgucuuccaucucaucaaagagcugauuucugagaagggacuggaaccucacgauauccgccucguguaccuggccugccuuaauaucuacaagcauagaggccacuuucugaacgacacacucagcggcgaugggauugacaauaucaacucccuguguaaugacuucaccucuuaucuugcggauuacaaccagaauagcgaggacgauggaacggaaaagauggaccuggauuccaccguucucgccggcguguuugaggaaacacugugcaacaagcaucugagcaauucugcuaaaaagcgggaccucauugauaaacuggggaucaccaacaagacaaaauaucuuaccgagaugauggcccugauuuccggacucgcuagcucugucuccaauauguucgccaaggacacguacgaugaggaacaaaagaaauuuaagcugagcuucagaucuuccaaccuugacgaggauauggugaaaguucaggcgaugcugacacccgaagaguaugaaaugaucuguauuaugaagaaaauccacgacuggagcguggucuccgugaucaugggcucucacaaguacauuagcgacgcccgcguggagcucuaugagaagcauaaacaggaucuggcuaagcugaaagccaucuacaaggaauaccucccugacaaauaugaugcuauguuccgggagaugaccgacaacuccuacagcgccuaugucgggaagguuucuuccaauaagaaaagccagacaggaaaccacaaggugcgcaugcaaagacggggcgccaaaugcaagcaggaagauuuuuacgacagaauuaaaaaggagaucaauucugugccccaggaagagaagauugauauccugcaggacauggagaccaacagcuuccuuccuaaacaacugaccaaugaaaacggcgucaucccguaucagcuccaucuggcugagcuuaagaaaauucuggauaaugcguccacauaccuccccuuucugaacucugccgacgaaacggggaucagcaauaaggauaaaauuauccagcuguucgaguuucgcauuccuuauuacgugggaccccucuucaaguccgagaaaaacaagaccaaugcuuggguugugcggaaggaaagcggcaaagucuacccuuggaacuuuaaugagaagaucgacgaaaaacagucugccgagaucuucauugaaagaauggugcgccacuguacauaucugaacaaugaguccgcccuucccaagaacagccugaaauacgagcgguuuagaguucucaacgaacugaauaaccugcgcaucaauggggagcggauuucuccggaacuuaagcaaagaaucuauaacgaacucuucaaggugaaaaagaaacgcauuaccaaguccaugcugugcgaauaccuguauaaaaauggaaucgcugauaaggacagcgagcucuccggcuuugacgggacauucgccaacgcgcugcuuucuuacggaaaguuucgggagcuguucaaugucgauacccucacggacaaacaggaagcugccgccgaggauauuaucaaguggagcacaguguauggcgacuccaaaaaguuccugcaggagaaaaucgaggaaaacuacggcccugagucugagaauccccugcuugauaacaagcaaauuaagagagucaugggguacaaauuuaccgacuggggaaaucucagccgcgaguuccugaaccuggaaggcgcugauaaggacaaugauaccacaaccggggaagugaugccucucaucacacggaugugggaggagaacuauaaucugauggaacuuauguccaacaaauuuagcuacagagacgcccuggcugagaagacggaagagauugagaaaacccucacagauaucgaauaugaggaccuggaagaucuguacauuucugcccccguuaagcggaugaccuggcagacacuucucauccugaaagagaucuaucagauuaugggauacgcgcccaagaagaucuucguggaaauggcccgcgaggaagaggagaaagucaacggcaagggggcuagaaaauccagccggaagaaaagacuggaagaccucuaucgcaauuguaaggacgccucuaaggagcuguccaccggcauuaaaaacgcugaugaagccauccuucggagaaagaaacuguaccucuacuaucugcagaagggaaaaugcauguacagcggcaagacgauugacuuuaagucucuguucaccaauaacuaugauaucgaccacaucuacccucaaagcgugguuaaagaugacucccuugagaauaacauggugcucgucgaacgcaauuauaacaauaagaaaagcgauacauuuccgauuuucucugacuggcagaacaagaugaaacccuuuuggaccaugcugaaggagcagggguucaucaaugaggaaaaguacaaaagacugacacggaccgaugagcucacggacgaugaacuggcgaacuuugugaaucgccagcuuguggagacaagacaagccaccaagguuauugcugagcugcucaaaaacuccuucgacgacaucgauagcaagauugucuaugccaaagcuggaaauguguccgaauuucggcauaaguucucuaugaaguacgacaaagagacagaaaagagcuccgugauccacccugagcuggucaaaugucgcaucauuaacgauuuccaucacgccaacgacucuuaccugaauaucgugguuggcaacauuuaugaugugaaguuuacccagaaucccuacaacuauaucaaagaauacaagaaacagaagaauaacagcgcccuuuccgagcaggagaaggaaaaauaucauauggacaagauuuucaauuuugaugucaaaagaaacggggagguggcuuggaucucucggggagacaauaagacccuggaaacaguucucaaagugaugcgcaagaacacgccuauugucaccagaaugaauuucgaggaacacggccaacuggcggaucucacaaucuacagcgccuccgacgcucugagcaagaaaggggugggcuauaucaagguuaaagccucugaugcccggcuugacgugcugaaguacggaggcuacaaaaaguauaagggggcuuacuuuuuccucgucgagcacaccgagaaaaacaagcgcgugagaacaauugaaaauaugccccuguaucugaaaaacgagcuuaauaccaaggagaaaaucgaacuguggugcgccgauaaggaaaacggacucggccugguggacccggacguccggcucgggaagauuaaacuguacuccaagaucagaauugauggauuugaccuuuaucugacgggccgcacagggaauaaccuccugaccagcaacgcgguucagcugaaaaucggcucuaauaagccuuccgauaacgacaaacuuuucuggcgguacuauaucaauaagcugagcaaauacaccgagaacucugaguuuguguccauucagaauaacaucaagcucuacgaucuguucguggaaauuaauaacgcuggagucuauagcaagagacagaaucccaucggcgacaaacuccuggaggggcgcuccaaguuuauuaaccuuacacugagcaaacaaguggaaacccugcucggaaucauccggauuuacucucuggagaaucagggcgccgaucuuagcaacaucgggggacaggagaagaauggcacaaugaaaccucauaagagaauuuccgacaagaaagaaguucugcucaucaaccaaucugugacggggcuguaugagagcaagauugaucuccugaaaaucuga

SEQ ID NO: 4470 - RNA, 4236 nt, Artificial Sequence
  Cas9 variant
augaagaacauccugggccucgaccuggggaccaauagcauuggaugggcccuuaucaaacagaacgcugaggaaagacaaggcuccauucuggggaugggaacacgggugcuccccaugucucaggauguccugggcgacuucgggaagggaaauagcguuucccagacggccgcgcgcaccggcuacagaggcauccggcgccuuagagagcgguuucugcuccgcagagaacggcugcaccgcgugcugaacauucucggguuccugccuuauuacuaugcugcccagaucgauuuugacaaaagauucggaaaguuuaaagccgagacagaaccgaaacuucccuacaauaacgagggcuucaucuuuaaaaauucuuucgaggaaaugcugagcgauuuuaaaauuucccaaccugagcuccugucugggaacaagaaagugcccuaugacuggaccaucuacuaucuucggaagaaagcugucagccagaagauugaaaaggaggagcuggccuggauccuccugaauuucaaccagaaacgcggauacuaccagcugagaggcgaagauuuugacgaggaaaaggauaaaacauucgugacccucaauguugacaaggugauugauuccggggagaaagucaagggaaacauccuguuugacauuuauuucacaaauggcuggaaauacgaaaagcaaaccacgaagccugaggauuggcuuggccggagcaaagaguucaucaucaccgaaucucugcucaagaacggggaggugcgcagaacauuuaaagcuguugacuccgaaaaggacuggauugccaucaaagcgaagaccgagcaggaaauugagacagcccauaagaccgugggaagcuauaucuacgaugcuauucugcagaaucccaaacagaagaucaaaggcaaacuuguccggacgaucgagagaaaguucuauaaggaggagcugcgcaagauucucgaaaaacaaaaggacuuucaccuggagcugcagaacgaagaucucuacucugacugcgugcgggagcuguauagaaacaaugauacacaucagcuuucccuggccaaaaagagcuucauccaccucuuucuggaggacauuaucuucuaccaacgcccucuuaaaucucagaaguccagcguguccaacuguacccuggaaugccggaaguacagagauaaaaauggggcugagggcauucaguuucucaaggucaucccgaaaucuaaccccuauuaccaggaguuccgcaucuggcaauggaugagcaaucugaagauuuaucggagagacgaugacguuaacaucacauccgaaugucugaaaaccgccgaggauuacgaagaccucuuuguguuccugaauauucgcaaggagguggaccagaaagcgugccuucggcauuuuaagcugagcgaaaagacccacagauggaacuaugucgaggauaaaaaguacccuuguaaugaaacaggaacgaugaucucugagcgccucaaaaaggugggggacucccccgauaacauuuucacccgggagauggaacagcagaucuggcacauuaucuauagcguuaaugacaaaacagaguacgaaaaggcccugaagucuuuugcuaaaaagaacgagcuggauaaugacagcuucuucgaagccuuuagaaaauucccucccuuugauuccgaguacggaucuuucagcgagaaggcuaucaaaaagcuccuuccgcugaugcggauuggcaagcauuggaacugggaagccguggacgagaaaaucaagaaucgcauucaaaagaucauuaucggcgaauaugaugagaacaucaaggacaacauuagagaaaagacccugucccuccagaaggagagcgauuuucaggggcugccucuuuggcuggcccaguacgucguguauggacggcacucugaggcuuccguugcgggcaaguggaauagcguggacgauaucgaagaguaccucaaagaguucaagcaacauucucugagaaaccccauugucgaacaggugaucauggaaacaguccgcgugguuaaagacauuuggaucaaguaugggaauggagccgcugacuuuuucgaugaaauccacauugagcugggccgggaaaugaaacuuccugccaaggagagaaacaaaaugacccagaagaucuccgaaaaugagaacacgaaucuccgcauuaaggcccugcuggcugagaugaugaacgacagcgaagugcagaaugucagacccuacucccccaugcaacaggagauccucaaaauuuaugaagauggggcccugaacucugagaucagcguggacgaugacauccuuaagauuuccaaaacagcgcagccuucuccgagcgaucugaagaaauacaagcucuggcuggaacaaaaguaccggucccccuauaccggcgacaucauuccucugaauaaacuuuuuaccacagaguacgagaucgaacacauuaucccccagagccgcuauuucgaugacucuuuuuccaacaagguuauuugcgagagccucgugaauagacugaaagauaacuacaucggacugggcuucaucaagcaguuucauggguauaaaauuucugacaagaccaaggucuucgaaguggaggaauacgaggauuucgugaaaaagaauuaugcuaacaaccgguccaaacgcagcaagcuccugcuugaggaaaucccugaggaaaugauugagagacagcugaaugacacacgguacaucucuaaauacauuagcggaauccucuccaacaucguucgcaagaaggagaaugacgaaggcgucaacagcaaagauauuauccccgggaauggaaagauuacgucucaacugaaacaggacuggggccugaacgauguguggaaugaccuuauccucccgagauuugagcggaugaacgaacugaccaaguccagcuauuucacaguguggaaugagaaauaccagaaguuucugccuaccguccccguggaguucuccaagggguuuucuaaaaagcgcauugaucacagacaucacgcccucgacgcccugguuaucgcuugugccacaaaagaucaugugaaccuucugaauaacaagagcgcuaaauccgaaaugaagcgguaugaccucaaaagaaagcugaugaaguucgagaaaaagaccuaccagcacucucaaacgggcgaacgcaucgucaaagaugugccuguugaguuucugaagcccuggaaugacuucaccguggaagccaaagagaaccuugaaaagauuaucgucagcuuuaagcagaaucugcgggugauuaacaaagcgacaaaccacuaugagaaguggaucgagaaagauaauguuaaggugaaaggacucgucgaacagcagggccugaacugggccauuagaaagccucuccauaaggacaccguguccgggaaaguggaccugcccggaaucaaggucccgaaaggcaagauucuuacagcuacccgcaaaucuaucgauacgagcuucgaccugaagacaaucaauuccauuaccgauacagggguucaaaagauccucaaaaacuaccuggaguauaagggaaauagcucugaagaggccuuuuccagcgaaggcauugaggacaugaacaauaacaucgagaaauucaaugaagggaagcugcaccagccuauuaccaaagugcggaucuucgagcuuggcucuaaguuuccccugggacagaucggcaacaaaaagcauaaguacguggaaaccgcuaaagggacaaaucucuucuuugccauuuacgaggaugacaagggaaaaagaacguaugagaccaucccccugaacgaagucauugagcgccaaaagcagggccucgcgccugugacacugaaauccaagaaugauuucuaccuuugcccgaacgaccugguuuauguggccgcugaaggggagagcgucaauaagaucgauuuuaaauacgccucucaggaauuuauucacaacaucuauaaggugguuuccuucagcggaucccagaucuucuuugugaaacaaaauauugcugucagcaucgugaacaaggccgaguucucuacccucaacaaaauggagcgggccguugacggcaagaugauuaaggauuguugcaucaaacugaagauugacagaaucgggaauauuacaaaaagcuga

SEQ ID NO: 4471 - RNA, 4239 nt, Artificial Sequence
  Cas9 variant
augaugaccaagaacauccugggccucgaccuggggacaaauagcauuggaugggcccuuaucaaacagaacgcugaggaaagaaagggcuccauucuggggaugggaacgcgggugcuccccaugucucaagaugcccugggcgacuucgggaaaggaaauagcgucucccagaccgcggcucgcacaggcuacagaggcguucggcgccuuagagagcgguuucugcuccgcagagaacggcugcaccgcgugcugaacauccucggguuccugccugauuauuacgccgcccagauugacuuugauaagagauucggaaaauuuaaggcugagaccgaaccgaaacuucccuauaauaacgagggcuucaucuuuaaaaauucuuucgaggaaaugcugagcgacuuuaagaucucccagccugagcuccugucugaaaacaaaaagauucccuacgauuggacaaucuauuaccuucggaaaaaggccgugagccaacgcauugagaaggaggaacuggucuggauccuccugaauuucaaccagaaaagaggguauuaccagcugcggggagaggacuuugaugaagagaaggacaaaaccuucgugacacucaauguugauaaggugauugacuccggcgaaaaagucaaggggaucgugcuguuugauguuuacuucaccaacggauggaaauaugagaagcagauuacgaagccugaggacuggcuuggccgcagcaaagaauuuaucaucaccgagucucugcucaagaauggcgaagugaaaagaacauuuaaggcugucgacuccgagaaagauuggauugccaucaaggcgaagaccgaacaagagauugagaucgcccauaaaacaguggggagcuacauuuaugacgcuauccugcagaaccccaagcagaaaaucaagggaaaacuuauucggaccaucgaaagaaaguucuacaaggaggaacugcgcaaaauucucgagaagcagaaagaauuucacccugagcugcaaaaugaggaucuguauucugacugcgugcgggaacucuacagaaacaacgaugcccaucagcugucccuugcuaagaaagacuucauccaccuguuugucgaggauauuaucuucuaucagcgcccgcucaagagccaaaagucuuccguuagcaauuguacgcuggaaugccggaaauacaaggacaaaaacggcgaggagagaauccaguuucuuaaggugauucccaaauccaauccuuacuaucaggaguuccgcaucuggcaguggaugucuaaccugaagauuuaccggagagaugacgaugugaauaucacaagcgaguaucucaaaaccacagaagacuaccaagaccuguuugucuuccugaacacccgcaaggagguggaucagaaggccugucucaaacauuuuaagcugaaugaaaagacccaccgguggaacuauguugaggacaagagauaccccugcaaugagacagggacgaugauucuugaacgcuucaaaaaggugggagauuccgcggacaacaucuuuacccgggagauggaacagcagauguggcacauuaucuauagcgucaaugauaagacagaguacgaaaaagcccugaagucuuucgcuaaaaagaacgaccucgauaauguguccuucuuugaggccuucagaaaauuuccucccuucgacagcgaguacggcucuuuuagcgaaaaggcuaucaagaaacugcugccgcuuauucggaccgggaaguauuggaacugggaggccguugaugaaaagacaaagaaacgcauccaaaagaugauuaccggagagugggacgaagauaucaaggacaauauuagagagaaaacgcucucccugcagaaggagucugauuuccagggccugccucucuggcuggcccaguacgcuguguauggccggcauagcgaagcguccgucgccgggaaauggaacagcgugaacgacauggaggaauaccuuaaggaguuuaaacaacacucucugagaaaucccaucgucgaacaggugaucacagaaaccauucgcguugugaaggacaucuggauuaaauauggaaacggcgcugccgauuucuuuaaugagauccauauugaacucgggcgggagaugaagcugccugccaaggaaagauccaaaaugacccagaagaucagcgagaacgagaauacaaaccugcgcaucaaagcccuucucgucgaaaugaugaaugacucugaggugcacaacguuagacccuacucccccaugcagcaagaaauucugaagaucuaugaggauggagcucugaauagcgaaauuuccguggacgaugacauccucaaaauuucuaagaccgcgcagccuagcccguccgaucugaagaaauacaaacuuuggcuggagcagaaauaccggucucccuauacaggcgacaucaucccucucaacaagcuguucacgaccgaguacgaaauugagcacaucauuccccaaagccgcuauuuugaugacuccuucagcaauaaagucaucugugaaucuuccgugaacagacugaaggauaauuacauugggcuuggcuuuaucaagcaguuccauggauauaaaauuagcgacaagacaaaaguguucgagguugaagaguacgaggauuuugucaagaaaaacuaugcuucuaauugguccaagcggagcaagcuccugcuggaagagaucccugaagagaugaucgagcgccagcucaacgacaccagauacauuucuaaauacaucagcggcauucuguccaacaucgugcggaagaaagaaaaugacgauggggugaacagcaaggacauuauccccggaaauggcaaaaucacaucucagcuuaagcaagauugggggcugaacgacgucuggaaugaucucgugcugccgcgcuucgagagaaugaacgaacugaccaaguccaaugacuuuacgguuuggaacgagaaauaucagaaguuccuuccuaccgugcccgucgaauuuagcaaaggauucuccaagaaacggauugaucaccgccaucacgcccucgacgcccuggugaucgcuugcgccacaagagaucauguuaaucugcucaacaaucagucugcucggagcgagaugaagagauacgaccugaaacgcaaacuuaugaaguuugagaagaaggccuaucagcacucccaaaccggcgaacggauugugaaagaugucccuguggaguuccugaagcccugggacaacuuuaucguugaagcgaaagagaaucucgacagaauuaucgugucuuucaagcagaaccugcgcgucaucaauaaggccacaaaccacuacgaaaaauggauugagaagaacaaugugaaagugaaggcucuggucgagcagcaggggcuuaacugggccauccggaaaccucugcauaaggauaccguuagcggcaagguggaccuccccggaacgaaagugccgaagggcaaaauucugacagcuaccagaaaguccaucgauacaucuuuugacaugaaaaccauuaauagcaucaccgauacagggauucaaaagauccucaagaacuaucuggaauacaaaggauccuaugaggacgccuucagcccugaaggcaucgaggauaugaauaagaacauugaaaaauucaaugacgggaagcagcaccagcccaucauuaaaguccgcaucuuugagcuuggaucuaaguucccccugggccaaauugggaacaaaaagcauaaguacguggagacggcgaaaggcaccaaucucuuuuucgccaucuacgaagaugacaagggaaaacggacauaugagaccaucccucugaacgaaguuauugagagacagaagcagggccuggcuccggugacauuuaaauccaagaaugauuucuaccuuagccccaacgaccuggucuauguggccgcugagggggaaucuguugauaaucucgacuuucaguccgacagccaagaguacaucaacaauguguauaaggucgugucuuucuccggaagccagauuuucuucguuaaacagaacguggccgucuccaucgugaauaaggccgaauuuagcacccugaacaaaauggagcgcgcuauugauggccggaugaucaaggaauguugcgugaaacucaagaucgacagaauugggaacaugacgaagucuuga

SEQ ID NO: 4472 - RNA, 4245 nt, Artificial Sequence
  Cas9 variant
augaagaaaauccugggccucgaccuggggaccaacagcauuggaugggccuucguggaggaagcugagaaugaauccgagaagucuagcaucauuaaacuuggcgucagaguuaacccccugacaguggaugaacagcaaaauuuugagaaggggaaauccaucacgaccaacgccgaccggacacucaagcgcucuaugagacggaaucugcagcgcuacaagcagagacgggagaaccuuauugauauccugaugaaaaauggauucaccagcgacgauacaauccucuccgaaaacggcaaucgcaccacauuugagaccuauagacugcggucuaaggcgguggcugaaaagauuagccugcaggaguucgcccgcguccuccugaugaucaacaagaaaagaggguacaaguccagccggaaggccaaaggaacggaggacggcgaacuuauugauggcauggagguggcuaagaaacuguauaauuacaaccucaccccugggcaacugugccuucagcugcucaaugaaggaaagaaacaucugccggacuuuuaucgcucugaucugcaggccgaguucgacagaaucuuugauauucagaugacauucuacaccgaauaucucacacuggagcuuaaggaggaacugcggggcaaaaagcgcgacgcuguuugggccaucugugcgaagauuuuuaaagagaagggguucgaacucaucggaaccaaaagacaaggcuccacggccgagcagaagcacgaaaacuacagcuggcgggcuaaagggcugucugagaaacuugagcuggaacagcucguggucgugcugcagcaaaucaauauucagcugaacuccagcucuggauaccucggcgccaucuccgauagaagcaaggagcuguuuuucaacaaacagacaguuggccaauaucagauggcugugcuugacaagaaucccaacgccgggcugcgcaauauggucuuuuaccggcaggacuaucucgaugaguucaacgcgauuugggaaaaacaggcccuguuccacccuauccuuaccgacacacugaaggaugaaauuagagacgugaucaucuuuuaccaacgccggcucaaaucccagaagggacugauuucuuucugcgagcuggagagcagaaagaucgaaguggagauugcuggccagaauaaaaccaagauggucgggucccgcguuaucccccggagcucuccucucuuucaggaguucaaaauuuggcaaucccugaacaauaucgaaguguuuggaaagggcaaaaagagcaagaaacagaaggagcagacccuuuucgaucagacagaagacccccuggaguuugggggaagacgcgaacucuaugaggaagagaaagagcugcuggcccuugaacucucuaucaagaaagagcugaagaaagcugauauucugaagcuccuguucgacaacccuaaggaacuugaucugaauuuuaacgccgugcaaggcaaucucacgcaggccacccuguucaacgucuacaaaaagaucauugagcugagcggccaugaaaucgacguggagaaagauuccgcuucuaagauucuuaaaagcaucgaggaaauuuuuaaggcgcucaauuauaacacagagauccugcacuucgacuccgaaaagagccaggaccagcaagccauguacaugcuguggcaucuccuguacucuuuugagggggauaauuccaacaccggaaacgaaaaucuuaucaacaaaauuagcaagcuguauggcuucgagaaagaguacgcuaagauccucgccaauguuucuuuccaggacgauuaugggucccugagcgccaaagcuauuuccaagauccugccguaccuuaaggaaggacacaaaucugacauugccugugaucucgcgggcuauaagcacagcgcuuccucucugacacgggaggaacuggagaacaaaaccuacaaggacagacucgagauccugcccaaaaauacgcuucgcaacccuguggucgaaaagauccugaaucagaugauuaacgugaucaaucucauuaucgauagccgggagcugaagaaauccgccaaggaaagagaggaacugacaaaaagcauuucugagaccaccaaacuucaucaacaguauaaagacauccucgccaaggcucccuuuaaccugacaaauaccucccggaacgauaucauucgcuacaaacuguacgaggaacucaaggacaauggguauaagacacuguacagcaacaaauauaucucuccugccgcucuuuucuccggcgauuuugacauugagcacaucauuccccagagcagacuguucgaugacucuuuuagcaauaagacgcucgaacugcgguccaucaacaucgagaaaggaaacaagaccgccuacgacuucauuaaaggcaaguauggggaaacaggagaggauaauugccuggacaaguaccuuaacagaaucgagacccuguauaaaaauggcauucucaagaaaagcaaguacaacaaacugaagaugcaggauaaggacaucccggauggguuuauugaacgcgacauccgggauacacaauacauugcgaaauaugccaagacccuccugggagaccuuguuaaauucguggucucuacguccggcagcgugaccgagagacugcgcgaagauuggcagcucgucgacgugaugaaggagcugaauugggaaaaauacaugcagcuggggcuuacagaggaguuuaccaacgaagagggccauagaauccggaagaucaaggauuggacaaaacgcaaugaccacagacaccaugcuauggaugcccugaccguugcuuucacgaagcggcaguuuauucaauaucucaacaaucugaacgcccgcagaaucuccgacgaacagggaauuucuaauagcgagaaagacgagcggaacaauguguccaucacaaccaacgauaugaagcucaauacacgcgacguccugggcauugaaaagaaggagcuuuacagagauaaccgggggaagcugcgcuucaaagcgccuaugccccuccuggaauuuagagaggaagccaagcggcaccuggagaacacccuuaucucuaucaaagcuaagaauaaagugaccacaauuaacaucaauacgcugaagaaagccggaggcguuuauaagaagacccagcucacaccuagagggcagcugcauaacgagaccauuuacggaagccaaaaacaguauaucgugaaggaagagacaauuaaugcuaaauucgacgucgaaaagaucgccaccgugacgaaccccguguaccgcgaggcccuccugaaacggcuugaacagaauaacaaugaucccaagaaggcuuucacaggcuccaacgcgcugaccaaaaagccuaugugguuugacgagcaacagaccgagaaaguuccggaaaaggucaaaacagugucuuucgagaccaucuacacaauuagaaaggaaaucagccccgaucugaagauugagaaaguggucgacgaaaaggugcgccagauccucaauaaccggcugaaugaguauaacgggaaugccaaacaggcuuuuuccaaccuugaugagaauccuauuuggcugaacaaggaaaaaggcaucacgauuaagagaguuaccaucacaggaaucaacaaugcccaagcccuccacgagaagcuggacaaagauggcaagcccauucucgacggggaaggcaaaaagcagccuguggacuucgucaacaccggaaauaaccaucacguggcuguuuacugugaugccgacgggaaucugcaggagaacgugaucagcuuuuaugaggcggucacacgccggaaucuuggacugcccauuaucgauaaagacuacaagaaagaugacggcuggcaguuccuguuuucuaugaagcaaaacgaauauuucguguuuccgaaugaguccaccggguucaacccuaaugaaguugaucuccugaaccccgacaauuacagccuuauuucuccuaaccuguuuagagugcagaaguucacgaucaaagauuauuucuuucgccaccaucucgagaccaaugucgaauccaacagcacacugaagggcaucaccuggcuccggugcggacugaacaauauugacaacaucauuaaagugagaaucaaucacauuggccagaucauccaugugggggaguacuga

SEQ ID NO: 4473 - RNA, 4248 nt, Artificial Sequence
  Cas9 variant
auggccaaguucaacaaacccuacagcaucggccuggacauugggguguccucugucggauaugcuguuaucaccgaggauuacagagugccugccuuucgguucaaggugcucggcaauacagaaaaagagaagauuaaaaagaaccugaucgggagcacgaccuuugucccggcgcaguccgcucaagugacacgcguuuucagagugaaucggcgcagaauugaccggcgcaaccacagaaucgccuaucuucgggauaucuuucagaaggaaauugagaaagucgacaagaauuucuaccgcagacuggaugaaucuuuucgggugcucggagacaaaagcgaggaucugcagaucaagcagcccuucuuuggcgacaaagagcuugaaaccgccuaucauaagaaguacccuacaauuuaucaucugcgcaaacaccucgcugaugccgacaagaacucccccguugcugauaucagagagguguacauggcccugucucacauucugaaauaccgggggcauuuccucacccuggacaagaucaauccuaacaauauuaacaugcaaaauagcuggaucaacuuuaucgaauccugccaggaggucuucgaucuugaggugagcgaagagucuaaaacaauugcggccaucuuuaaguccagcgaaaaucgccaggagaaagugaagcagauucugucuuauuuccaacaggaacuccugaagaaagacaaguccaucuucaaacagcuucugcagcuccuguuuggacugaagaccaaauucaaggacuguuuugagcucgaggaggaacccgaucugaacuucagcaaggaaaauuacgacgagaaccuugaaaaccugcucggcacgcuggaggaggauuuuucugacgucuucgcuaaacuuaagauucugagagauaccauccuccuguccgacaugcugacauauaccggcgccacacacgcucgguuuagcgccaccaugguugaaagauacgaggaacaccgcaaagaucuccaacgguucaaguccuuugugaaacagaaucugucugagcaggacuaucuugauaucuucgggagaaagacgccuaacggauuugacguggauaaggaaacaaaaggcuacgucggguauauuagcaauaagauggugcugaccaacaaacaaaagacaauccagcagaauuucuacgacuacauuuccggaaaaaucaccggcauugagggggcggaguauuuucucaacaagaucagcgacggaaccuuccugcgcaagcugcggacaacggauaauggcgccaucccgaaccagauucaugcuuacgaacuggagaaaaucauugaaagacaaggccgcgacuaucccuuccuccuggagaauaaggauaaacugcucucuauccugaccuuuaagauuccuuacuauguugggccccuugccaaaggaaacaauucccgguucgcuuggaucaagagagccacaagccaggacauucuggaugacaacgaugaggacacccgcaauggcaaaauccggccuuggaacuaccacaagcucaucaauauggauaagacaagagacgccuuuauuaccaaccugaucgggaacgauauuauccugcuuaaugaaaaagugcuccccaagcgcucucugauuuaugaggaagucaugcugcagaacgagcucacgcgggugaaauacaaggacaaauacggaaagacacauuucuuugauagcgaacugagacaggagaucaucaauaaccuuuucaagaccaauuccaaacggguuucuagcgcuaugcugcucaacuaucuggagaauuacaccaaccugcaagcgguggaaauugucuccggcaucgagaaggggaaaagccuuaauucuacacucaagaccuauaacgaccugaaaacaaucuuuuccgaggaacugcucgacagcgaaauuuaccagaaggagcuggaggaaauugugaaggucaucacgguguucgaugacaaaaagucuaucaaaaauuaucuuaccaaguacuuuggacgccuggaguuccucaacgaagagagaauuaaucagcuguccaaacugcgguauacaggcuggggcagauacagcgccaaacuucuccuggauauccgcgacgaagauaccggguuuaaccugaugcaguuccuccggaaugacgaugagaacagaaaccugucccaacuuauuucugacagcacacuguccuuugauucugcuaucaagagcauucaguccaagagcaccguugaggacgauguguucgacgaaaucaagaaacucgccggaucuccggccaucaagcgcggcauucuuaauuccaucaaaauugucgaugagcuggugcagaucauuggguacccuccccagaacaucguuauugaaauggcuagagagaauaugacgaccgaggaaggacaaaagaaagccaagacacggaagaccaaacuugagagcgcgcucaagaacaucgaaaauucugugcuggagaacggcaaagucccucacuccgacgaacagcugcagagcgagaagcucuaucuguacuaucuucaaaaugggaaagacauguacucucuggauaagacaggcagccccacgccccucuaucgcgacagacuggaucaguacgagguggaccacaucauuccuuauuccuuccugccgaucgauagcauugacaacaaggugcuuacccaucgggaaaauaaccagcgcaaacugaauaacauccccgauaaggagacaguugcuaauaugaaaccuuuuugggaaaagcucuacaacgccaaacugauuucucagaccaaguaccaaagacucacaaccuccgagcggacccccgacggaguccugacagaaagcaugaaggccggcuucaucgagcgccagcuuguggagacgagacagaucauuaaacacguggcucggauccuggauaaucgcuuucucgacaccaagauuaucacacugaaaucccagcugauuaccaacuucagaaacacauuucauaucgccaagauccgggaacuuaaugauuaucaccaugcucacgacgccuaccuggcggucgugauugggcaaacccuccugaaagccuauccuaagcucgcucccgagcugaucuacggacaccaugcccacuucaacagacaugaagagaauaaggcuacgauucgcaaacaccuuuauucuaacaucaugcgguuuuucaauaacccgaauagcaagguuuccaaagacauuuggaacugcaauagagaucugccuaucauuaaggacaucaucuacaacucucaggugaauuuugucaaacgcacaaugauuaagaagggcgccuucuauaaacagaacaucauucccaaugauagcuccgugaccguugacaagcgguuuccuaucaaaaacaagaaauaccucgaucccaagcuguacgggggauauuacgaaagaaauucugcgcugagcguguucauuaucggccaguccuucaacaaaaauaacaaacuuaaggucgugaaggaguuuuaugacaucaacauuaucgauuacccucuguucaauaccgaccccaugagcuuuuucaacgaugacucugagaauggguuucucacaaagaacaaucugcaauccguucaggccuucuauaaaauuccgaaguacagccucauccagaaaaacgauggcacccgcaugcuguuugaaucuacaacgaauuuccacaaggcuacccaauuuaaacuuacagaggcccagaacgaacuguucuuucauaugaagcggcugcucaccaagacagacuucauggaucugaaauccgaggagagcauuaaggaaucucaggacuuuaucaugaaucacaaaaacgaguucgacaauaucgugaacggacuuuucggcuaugcugaaagacagcugggguccaagagccucuuuacccaagcccaugaggccuacaagcugcgcaaauacccugucuucucccucaaugaagagacgauucgguauuacuaugauaacuuucugagacuuuucagccugaccaagucuggaacaagcuccggcuacgugguggggcuguuugaggcucccaaacuccggaaugucguuuaucgcgcgaccaaggacgaaucuaacgccacacugauccaccagagcauuaccggacuuuacgagacaagaaucgaucuguccaaacucggcgaagacuga

SEQ ID NO: 4474 - RNA, 4248 nt, Artificial Sequence
  Cas9 variant
augaaccugagaaauguggccaaggagggcaucaacuacaauauugggcucgaccugggaaccggcagcgucgggugggcuguuacagaugaacagggagagcuuuucuccuuuaaaggcaagacgaccugggggucucggaucuuccccacagccgaaaccgcggcugacacacgccugaaaagaggacaacggcgcagauaugcccggcgcagauggcggcucgaucugcuucagagccuguuugaggaagagauuaagaaaguggacccugaguucuuuacccgccucagacagucccaucugcugaaggaagauaagacauacgccgcuauccucucuagcaaaggcgccacccggccgcuguuccccgagggcgaagcugagguggaguauuacaagaaauauccuacgauuuaccaccuucgcaaggcccugauggaauccaacaaucaggaggacaucagacucaucuaucuggcguuucacaacauugucaaagcccgggggaauuuccuucaucaagauacccccggacugacagcuucuaacgccaauaugggcgacgcuguggaaaagcucugcagcgcccuggaggauugguguuccagccagaacaucgaaugcgcgauucgcaagaaucagaaaucuauccaggaccugauggaggggaagaccauugagccuuccgaaagcaacgcccucaaagagacauuugaugcuucuagauccagccggaaggacaaagccucuguucuggcuggauggaucgccauucaacccggcgaacaguucgagccuaagcaggccaaagaugcuuccaaggaaaucgcgaaugccguguuugggcuuagcgcuaacaugaagaaagucuucguggagcuggaggaagaccagaagaucuaccucaauaacgacgagcaaguugaagccuuuuacaccguguguccggaugagggagucgcccuguucgaagcccuucaguccauguauucugcuuacgugcugaugggcauucucaaaggcgcggacgggggaagcaucuccagcugcaagguggcugccuaugagcaguacaaagaggaucugaagcugcucaagacgcuggucagagaguucgcccccaaaaaguaugacgaguuuuuccgcggcgauauuuuugacgcuaaaaagggguuccggacaagaaacuacgauccugccaccgcuaaaggauauacaaaguacaauucuguucgcggcgccuccuacgacgcguuuaagaaagaaguggagaaacuuuucgaggggaccgccgcugaagaggaugugcgguauaccgacaugaugcaaagauuugaugaaggaacauuccugcgccggcucaagacgagcgacaacggcucuauccccuaccagcugcaccuugaggaaauggucgccauuaucgagaaucagaagaccuuuuauccuuuccuggaggaaaacaaagagaaguuugaaagccucgugacauucagaauccccuacuauguuggcccgcugacccagaagaaugcucgcccugacaaccaugggaaugcccgguuugcguggucccaaagaaaagagggacaggaaaacgcccgcguguaccccuggaauugggaggaggucauugaucggaagcagucugcugccaaauucauggaaagacugacaggcaccuguacguauauccucgaggaaccugugcugccccgguacagccuucuguacgaggaauauugccuccugaacgagcugaauggggcucgcuggagagacaugggaggcgauuggcaccgguucgacuacgagacaagaauggauauuaucgaagaccuuuuuaagaaaaagaaagggaccguuaaguaugccaccguggccgauuggcucguccgcgagaagcaccgguccugugcugaagugaaaggcggacagggcgagacaggguucgagagcaagcugucuuccuacgucuuuuucaaaggagugcugcauguugacgaaauugaugaggcggacauccccaugaucgaagaacucauuugguggaacacccuguuugaagauagaagcauccuuaaggagucuauugaggacaaauauggcgaucgccugaaugacgaacaaaucaaggccauuugcaagaaaagauucacaggguggggacggcucuccaagaaacugcuguguggcaucaaggcucagacggacaacgggccuugcagcauuauggaugugcuucgcgagggcaauccgaacaacgacgccagauccgccaccauggucuuuauggaaaucauccgggaugacaaauucggauuuacaaagcucauugaggaagagaauaagaaacgcaucucuagcguggaugacuucgauguuaacgaccugcccggcuccccugcugugagacggaccgucaaucaggccaagcgcauuguggaugagaucguggggauugcgggaugugcuccccagaacaucuuuaucgaaguuacaagagacgaggauggccggaauaaagggcgcagaaccaagcggagauacgacgccauucaagaagccgucaaagugcugaagaaggagcagaaagaauauuucgaugcuaacguggccgaccuccugaagaauacggcgccugcugcccuugacgaugagcgccuggcccucuacuuuaugcagaacggaaaaugcauguacugcggcaaggaccuggauaucaaucagcuggacaaauaucaagucgaucacauucuuccccagucuuacgugaaggacgauagcuucgagaacaaagcucucguucauuccgacgauaaucagagaaagagcaacucuaugcugcuggacgauuccaucauucggaagaugaaaccguauugggaagcccuccgcagcgcugggcugaucggcgagaagaaauucaagaaucuuacccgggugagagucucugacaaagaacugggaggcuuuaucgcccgccaaaugguggagacaucccagagcaugaagcucaccucucugcugcuugagcaggcguacccugaaacacagguucggcccgugaaggccggguucagcuccgaccucagacgccggcugaaacuggucaaguguagagagauuaacgauuaucaccacgcucaugacgccuaccucgcuugcgaagugggacaauuuaucgcccugcggcacaauaaacuuuaugagaacccuauuggcuacagccaugccguuaaggauuucaucgcuaaacgcgcgaaguacgccucugaacacgggaagcccauggacaccuauggaaugccuggcuccagcuccuuugugauuucuagcuucaugacguccggguuugaugaggagacaggcgaaaucuucaaagacgcuugggaugccucucuggccgcugucagaauccaucaggcccucaaccggaaggacuguuacauuagccgcaugcccgaggaaaccuccggagcguuuugggaugcuacaaucuauucuccgaaacagaccaagaaaaagcugagccugccucuuaagaaaggccuggacccccagaaguacggguccuauagcagagagcaauucgccuacuuuuucguguaugaagccaaaaagauuaaaaagaaggaggagaccaaagaauacguguucgcuucuguccccguucagguggccgcgcucguggcugccgauccuaaugcccugaucgaguuugcuaaggccgacgcugaggaacggggacucaaauucgccaagauugucagagaaaaaguguacaaguaucagcugaucgagguuaacgaugagcgcuuuuucgugacaggccuucggacggucagaaaugggcugcagauugcguuuuccgaacaagaccgcaacaucgugagcggaaucguugagggcaauucuuccaacaauaaccuccuggacauuuacgauaaaaucaccaaucgguaugcccuguacgcuagcagauucggcaaacuucugaaccucucuggguaucgcgaaaauuuuauucaggccucccuggaggaccaggagcgggugguccucgcucugaucagccuuuucaacgccagaacaaauaugauugaucuguccgccaucggaagcucuaagaccgugggcaacaugagcaugacauuugcuaaggaaauggcgauggccgacaaucgcuucgcuuuuaucgaucaauccguuaccgggaugcucgagagaaagacguaccuguga

SEQ ID NO: 4475 - RNA, 4251 nt, Artificial Sequence
  Cas9 variant
augggcagcagaaucauucccaugucccaggacauccugggggaguucggaaagggcaacucugugagccaaaccuccgaacggacagccuaccgcucuacgagacggcuccgcgagagauuucugcuucggcgcgaaagacugcaccggguccucaauauucuggauuuccuuccuacccauuaugcuagccagaucgacuuuaaaaagcgccuggggaaauucaaggagaacaaagaaccgaagauugccuacgauaauaaguccuuucucuuccuggacucuuuuaacgagaugcugaaagauuucgagcaggaacagcccaauaugcucaucaacgagaagggagaaaagaagcugaucccuuaugacuggacacuuuacuaucugcggaaaaaggcgcucagagagaagauuagcaaagaggaacuguccuggaucauucuuaauuuuaaccaaaagcgcggcuacuaucagcugagaggggaggaugaagaggaaaaucccagcaaacucguugaguuccacucucugaccgugguggacgucgugccugaugagcccaucaagggaaaacuggaaacaugguacuccauuauccucgacaacggcuggguuuaccggcgcagcucuaagaccgagcuguaugauuggaaagacaagauuaaggaauuuaucgugacaaccgaucuuaauuacgacggcacggucaaaaccgacaaggaggggaacgugaaaagauccuuccgggcuccuagcgaaacagauuggacccugaucaagaaaaagacagaguaugagauugaacagucuuccaagaccaucggagaguacauuuauaauacgcuccugaaauacccggaacagaagaucagaggcaaacuuauucgcacaaucgagcggaaguauuacaaagaggaacugaagcaaauccuccugaagcagaccgaguuucauaacgaacugaaagacgauagccucuacuaugacugccugagagagcuuuaccgcaauaacgaaucccaccagcuguuccucgagaagaaaaacuucgcccagcuguuuauugaggauaucauuuucuaucaacggccccuuagaucucaaaagagccugaucuccaauuguccucucgaauuuuacaaauucaaggacagcguugggaacgagaaggugcagcaucugaaagccauucccaagucuaauccuuuuuaucaggaguuccgcaucuggcaguggaucuccaaccugagcauuuacucuaaacucgaugacagcaauuuuacaucccacuucuuugauucuaccgacgauugggaaagccuguucgaaaugcuuaacggacggaaggagaucgagcagaaacagcugcucaaguuucugcuggagaaaaagggcuucaaggggaaaucccuuagcucugaaauugaaaaguauagauggaauuacgucgaggacaaaaaguaccccugcaacgaaacccgcucccucauccaaagccggcuggacaaaguggcuaaucugccggagucuuuucucacaagacacguggagcaggaacuguggcaucuuauuuauuccgucacggauaagaucgaguucgaaaaggcccuggacaccuucagcaaaaaguacaaaauugauacaccuaccuuuguugacgcuuucaagaaaugucccccuuuuaaguccgaguauggaucuuucagcgaaaaggccaucaaaaagcuccugccccugaugcgcacaggcaaauacugggaucuugacaacaucgauaaggcgaccaaacagcggauugagaagaucauuuccggcgaguaugacaaggauaucagagaccgggugcgcgaaaaagccauuaaucuccugucugagacggauuuuaacagacugcagcucuggcuggcucaauacaucguguaugaccggcacagcgaagccacaucccuugauaagugggagaccaucgacgacauugucaccuaccugcauagcuucaaacagcacucucucagaaaucccaucguggagcagguuauuacagaaaccauccgcguggucaaggauauuugguccaacuacgggaauggaagcaaagacuauuuuaacgagauccacguggaacugggccgggagaugaagcugccugcugaagagagaaaacgcauccaggagaagaacucucaaaaugaagauacaaaccuuagaauuaaggcccuccuguccgagaugcagaaugacccgaacguugaaaaugugcggcccuacagcccuguccagcaggagauccugaaaauuuaugaagagggggugcucaacucuaauaucgagauugcggaugacauccugaagaucagcaaaacggcccaacccuccagcucugaucuuaagcgcuacaaacuguggcucgaacagaaguaucaguccccuuacaccggagagauuaucccccugaacaagcuguucacaccggaauaugagauugaacauaucauuccucaaagcagauacuuugacgauuccuacaauaacaaagucaucugcgagucugcugugaauaaacuuaaagacaacagccucggcuaugaguucauuaagggguacaauggacagaucguugaauguggcuuuggcaaaaaggugaagaucuucuccauugaugaguaugaagacuuuguccagaaaaacuacgccaauaaccggucuaaggcuagccgccugaugauggccgauauccccgagaaaaugauugagagacagcugaacgacacccgguauaucuccaaguacauuucuaauauccucagcaacaucgugcgcuccgaaagcaaugacgaugggguuaacucuaaaaaucugauuuccgugaacggaaagaucacaaccguccuuaagaaagacuggggcaugaaugauauuuggaacgaccugauccucccuagauucauucggaugaaucaaaucacggauagcgacucuuucaccacauggaacgagcgcuuucagaaguucauccccaccgugccuauugaacuguccaaaaauuuuagcgccaagagaaucgaucaccggcaucacgcuauggacgcgcuggugauugccugcgcuacaagagaucauguuaaccuucugaauaaccucuaugccaaaucuuccgcccgcuacgaccugaaucggaagcucagaaucuucgagaagaccacguacaaagauauuaagacagggcagaucauugaacgcgagauccccaaggcuuuucugaagccguggcagaacuucaccacagacgccaaagacgcgaucgagagcauuaucgucuccuauaagcaaagccuucgggugauuaacaaaucuaccaauuacuaucagaaguggguggaaaaggauggaaucgucaaaaaggagaaaauuaagcaggaaggcaaaaacugggcuaucagaaagccucugcacaaggacaccgugagcgggcucguucagcuguccugggugaaaguccccaagggcaaagugaugacagccacgcgcaagucucuggauagcuccuuugaccuuaaaaccaucgccacaauuaccgauacaggaauccaaaagauucugaucaaguaccucgagucuaaaggcaauaaccccgaaagcgcuuucuccccugaggggauugaggacuuuaauaacaauauccaccuguauaacgauggaaagaaacaucggccgaucaccaagguuagacucuacgaaauuggcucuaaauucccccugggggagaagggaaauaagaacgccaaauauguggaagcugccaagggcacgaaucuguuuuucgcggucuacgccaacaauaaaggggagcgcagcuucgaaacaaucccucuuaaccucgugauugaccggcugaagcugggccuuuccgcuguucccgagaccaaugagaaaggagauaaccugcucuuucaccugagcccuaaugaccucguguacguccccucugaagaugagauggaaaaccugaaacuuaucaaccuggagcauauuuccaaagaccagcugaauagaaucuauaagauggugagcucuaccuccaaccgguguuucuuuauuaagagcgagaucgcccucuccaucgugaauaaaauugaauacucuccucugaacaagauggagaaaagcaucgaaggcauuaugaucaaggaugucugccuuaaacugcagguuaaucgcauugggaaccucgagagauauuucuccuga

SEQ ID NO: 4476 - RNA, 4257 nt, Artificial Sequence
  Cas9 variant
augaaggugaaaaacauccugggccucgacauuggggucaccagcaucggauucgcccacguuacagagaaugaaaaggauaacaaaucccauauuaagcagcugggcgugagaaucaauccccuuacgguggacgagcaaaccaacuuugaaaaagggcggccugcuucugucaaugccgaucgcacacugaagagaggagcgcggaagaugcucagccgcuacaaagacagacggaagaaccugauugagauccuuuccaaaaccggcuucaucaauucugaaagcauucuggcugaggaugggaagaacacaacccacuccacaugggcccuccgcgccaaggcuucuagagagcggaucgaaaaggacgagcugggacgcgugcugcucgccauuaauaagaaaagaggcuauaagagcucccggaaagcuaagaacgaagaugagggccaggccaucgacgggauggcgauugccaaacgccuguacgaggaaaaucuuaccccgggacagcugguuuaucagcuccugagagagggcaagaaauacauccccgauuuuuaucggagcgaccuucaagaugaacuggacaagguguggaacuuccagaagcaguuucaucaggagauucucacggauaccuucuacaaagacauccaagggaagggacagcgcgcuacaucugccuccuuuuauggcgucuacggguucaauaccgcugaaaacaaaggaagcagagaggagaagcggcugcaggccuacgcguggagaucugacgcccugacaaaacagcucacccgcgaagagguggcuuuuguuaucacggaaauuaauaacaaccugaauaacuccagcggcuaucuuggcgccaucucugaucgguccaaggagcuguucuuuaauaagaaaacaguggggcaauaccucuaugaacagcugcagcaaaacccucacaccagacuuaagaaucaggucuucuaccgccaggacuaucuggaugaguuugagacaauuuggaccauccagagccgguacuaucccgaacucaccgacgaucugaaaagagagauucgcgacguggugaucuucuaccaacggaagcugaaaucccagaagggacucgucucuuucugcgaacuggagagcaaggaaaucaugauugagaaaaacggcaaggcugccguuaaaaagaucggguccaaaguggccccuaagagcucuccccuuuuucaggaguucaagauuuggcaagugcugcauaaugucgauaucaaaaacaagaaagacaagacaaaaagaccucucgaugacuccgaaaaggaguaccuguuuaaugaacuuaacauuaaaggaaaucugaaggcugcgaaggugauccaacuccugacgcugaacaaaaaugagaccgagcucaacuauacacagcuggaaggcaaucgcacccagaaggcccuuuacgaggcuuaucugaaaauccucgauacagaaggguacgacguuaacaaccugcugggaauuaagagcaauaaagacgagguguuccuugaugaccucgaugucaacgcccuggaaaucaagaccaugauuaagcagaucuuuaaugcccugaacauuaauacgggcauccucgacuucgaugcugagcuggacggcaaagccuuugagcaacaggcgucuuaucaccuuuggcaucugcucuacagcuaugaagaggauggguccaagucuggaaacgaacaccuguacaaacugcuugagaauaaguucggcuuuaaaccggaacacgcucggauucucgccgggaucacacugagcgacgauuacggaaaccuguccgccaaggcuaugagaaagaucuauccccagauuaaagagaauaacuucagcaccgccugugagcucgugggcuaccgccauucuaaaaauucccugaccaaagaagagaaccaggaacggccucuuaagaauaaacuggagcuccugaagaagaacagccugagacaacccguuguggaaaagauccuuaaucagaugauuaaccucgucaacgagcugaucgacaaaaauucugagaaagaugaacagggguccauuaucgaguauuuucgguucgacgaaauccgcauugagcuggcuagagagcucaagaaaaacacagaugaacggagagaccuggacgccgcgauccgcgagggcaaucuucggaacgaaaagauuuacaaacugcuccaagcccaguuuggaaucaagaauccuaccagaaacgauauuauccgcuauagacuguacgaggaacugaagaauaacggcuauaaagaccuuuacacaaauagcuacaucccccaggagaaacucuucgggaaagagauugauaucgaccacauuaucccgcaguccaagcuguucgaugacucuuuuagcaacaaaacgcugaccuauaauacaaccaacaaggauaagggaaaucaaacaggcuucgacuacauugaauccaaauaugggaucgauggaaucgaggcuuacaccgcccggauugaaaaccucuuugagucuggcaagaaaaauaaggaagagggggugagcaaagcuaaguaucagaagcugcuuaaaaaggaguccgaaaucggcgacggauucauugagcgcgaucugagagaaagccaguacaucgccaaaaaggcgaaagagcuccugcugcagauuacgcggucugucguggccaccuccggcagcaucacagcucgccuuagagaagacugggaucugguuaacgugaugaaggagcucaaccugccuaaguaucgggcccucgggcugaccgagauggaggaacgcaaauacggacaaaaggucgaagugauuaaagacuggacaaagagagacgaucaccggcaucacgcuauggacgcccuuaccaucgccuuuacgaaacauaaucacauccaguaccugaaccaucucaaugcucgcaaggaugagcagcacaaggagcacaaaauuaucaacgcgauugaaaauaaggagacaauccugauuaccgacaaaucuggcaacagaaagcggguuuucaaagcccccaugccuaauuuuagacagacagcuaagcaauaucuggaagaggugcuuaucucccauaaagccaagaacaaggucgugaccaaaaauaagaacaaaauccuggggaaggaaaagauucaggagacccucacaccccgcggacagcugcacgaucaaacgaucuacggcuucaauugguggagccggauuacccucucuaagaaggugagcagaaacgagaucgagaaaauuaucgacaauaacacaaaguuuuuccugcaggaauuuauccagcuuaaaggguccauugccaaggcuuucagcgaugccgaacugaauaaacucauguauaagggcaagauccugaaagagauugaaguugcgauccccugcuacacccagcgcauugacaucucuaaggucuuuacagauucccagaaaagcaacuccgcuaaggagaaaaauauuaagaacauccuggaccuuaaggugcggaacauccugcagaauagacucucugaguucaaaggagauuucaagaaagccuuuagcgaccuggacaagaacccuauuugguucaauaaagaaaagggcaucuccauuaaacgcgugaucauuucuggggucaagaacguggagccgcuccauuauaagaaagaucaccugggaaaugacauccuugauggcaaggaaaaccggauccccguugacuuuauuagcaccgggaauaaccaccauguggccaucuaccaggaugagaaaggaaaucugcaggaaaaggucgugucccuguucgacgcuguuaaacucgugaacgccgaugagccugucauugacaagacguauaaucaaggccugggguggcaguuucuuuucacaaugaagcagaacgagauguuuguguuccccaaugauaacaccggcuuugacccuaaagaaaucgaucugcucgaccccucuaauaagaaacugauuagcccgaaccucuucagaguucaguccaucagcaucgugcaauacggaaacaauauuguccgcgauuuuaaguuccggaaccaccuggagucugugcuuaaugacgacaaagugcugcauggcaucaccuuccagcagauuaagucccuggggccucuccugaacaucgucaagguuagaauuaaucaccuuggagauaucgugagcgugggcgaauacuga

SEQ ID NO: 4477 - RNA, 4260 nt, Artificial Sequence
  Cas9 variant
auggccaagccccagaacuacaccaucggccuggacauugggacaaauagcgugggauggacggucaccgaugaccaaaacaauauccucagaauuaaauccaagaaagcuaucggcgcccggcuguucgaggaagggaagguugcggcugagcgcagaucuuuucggacaacccgcagacggcuuagccgcagaaaauggcggauuaagcugcucgaagaacuguucgaugaagagaucuccaagguggacccuaacuuuuucgcccgcucucacgagagcuggaucuccccgaaagauaagagagaacgguauucugccauuguguuucccacaccugaggaagacaaaaaguuccauaaugaguaccccaccaucuaucaccuucgcgauagacugaugaaagacgaucagaagcaugacauucgggagaucuacgucgcuauucaccauaucaugaaguaucgcggaaacuuucuccacgaugaaagcauugagacauacagauccggcaugagcucucuugggggaggcgacgaacggaccauccugaauacgaaaauccucgaugaccugaacgacgccuucgcugauaaucuugccacccagggcauuuccgugaacagcgcgucugccgaccagaucaaugagauuguuacauccgggcaccugaacguggauagccaaaaggcuaucgccaaacuccugcuuccuaccacacugucuuccgacgauaagaaacaggacaagaaaauuaagaagcucgcuaccgaugccgcgaaaaaugucgccagcgcuuggcugggauauaaggccaacuuugcugccauccugaauauccaggaaguggacaaagauaagaaaaagauuuacuccuucgcccuccagggcgcugacgaggaggauaagguugaaacgcuggagucugugcuuagccaagaccagaucgaaauugucgacagaaucauucgcauccggcaugcgaucgugcugggggagauuauccccgugggaaugacacucuccgaagccaugauugagaaauacgaucagcacgcuaaggaccugaaaaaccuuaagaccgucaucagaaaccugaaagaucgcaagaaugccguuaagcuccaggccauuuaugaccuguacgugaacaaucggcaugcugauacagccaaagcgaugaagcuggcuggcgugaaaaagagaaccgagcuccuggaaccugaggaauuuaacaaaagcaucgagaagcugcuggacgauucuccggucuccgccgaaauuaagaaacgcaucgccgagaaggacuuccucccccugcaacggagcaauucuaacggggugaucccuaaucagcuucaccagauugagcuggaugaaaucauuaaaaagcaaagcaaauauuaccccuuucucggagagaccaacgaacacgcuuccgccgacguugcuagaaaggccccuacaaaacuggaucagcugcucacguuccgcgugcccuauuacgucggcccgcugaucaccaaggaggagcaggaggagcaggacggccauucuuucgcguggaugauucggaagaauccuaaagaucacgaaaagaucacacccuggaacuuugacgagaaaguggacagaauggccagcgcuacccaauucaucaagcgcaugacaaccaaagauacguaucuucugggggaagacguucucccuuccagcucucugaaguaccagcuguuuacagugcuuaaugagcucaacaaucugcggauuaaccauaagaaacugaccagagaggaaaaggagcaggucaucgaagaucucuucaaaaaguacaaaaccgugaaggccgacaaguuuaaaaauuauuggcagaagggacacgcuggccuggaugucaaaauucaagggauggccgaccccgagaaguucaacuccacaaugagcaccuacaucgaucuucagaaaauuuuuggagaccagcuggaugacgcgcagcggcaaaacgauuucgaaaagaucaucgaguauucuacaauuuuugaggaccgcaagauccucggcgaaaaacugagagccgauuucguguggcuguccgaggaccagauuaagcggcuuugcagacuccgccugcagggguggggacggcugagccucaaacugcuuacgagacugaccgacgcugauggccagaauguucucgaacgccugcugaacuccaaugacaacuuuaugcaaaucgugaaggaucccgucauuaaagccaagaucgagcagaaaaaucagaaacuucucagagcugacuggucugaaaacgccacagagagcauccuggaugaggccuacaccuccccucaaaauaagaaggcuauucggcaagugaugcgcguugugcaugacaucgucaaggcgugugauggcaaccugccggccaaauucgcuauugaauuugccagaucucaggacgaugaccccaagcggacaguggcccgcgcugauagacuccagaaaaucuaugcccaaauuagcgacgaggugguuucccagggggucaaggaccagcugagcggaaugaagucucuuaaagaucgguacuaucuguacuucaugcagggcgggcgcgacgcguacaccggaaagccucucaauaucgauagacuguccgacuaugauauugaccacaucaugccccagagcuucaucaaagaugacucucuggauaaccgggugcuugugacgcgcgcugucaauaaccagaaguccgacaaugugccuguucuccuguacggcaaccaccugguggccgaucucgggauuaccaucagagaaaugugggaccgguggcagaaaagcggcaugauuucuaagagaaagcuggccaaucuucugacagaucccgcuacccucagcgaguaucgcgccgagggauuuaucaaccggcagcuggucgaaacaucccaagugauuaaacugaccgcgacgauccuucagagcgaguucccggacucuaagaucauugaaguuccugcuaaauacaacuccauccugagaaagcaguuugaccucuauaaaagccgcgaggugaaugauuaccaucacgccauugacgccuaucuguccacaaucgucggcaacuaccucuaccaaguguaucccaaucugcggagacuuuucguuuacggggaauuuaagaaguucucucauggagaggaggaaagcucccaccaggcugugcgccgggucaaaucuaugaacuuucuggaugaccuccugagaggcaagcacggggaugacauuuauugccgcgugaccggagaggugaucuucagccggaaagauaucauuuccaagcugaaacaggccuacucuuuuaagcagaugcuugucacacaagaaguuuucaccaagaaaagcgcucuguuugaccagaccguguauccuucccccgccagagauagcaagacacggucuggccucaucccucgcaaacaggggauggacacggagauuuacggcggauauuccggcaauaaggaugcguacuucgugcuggcccaggucgugaaaagcaaggggcauacccuccaaguugugggaguccccaucagagcucugcgggcccuugcuaacuguucuaauuacuccgaacagcugcucaaaauugugaaggcccagguucuguuuaacaagaaaacaggcaaggccaaaaaggggaucagcgacgugcgcauucugcuugauaaaaucccguauagacagccuguccuggacggaucugcuuucuacaugcucggcuccagcaccuauaaguacaaucugaagcaaaucucccucagccagcagucuaugaaauauauucuggacuacaucgaugaccccaacuucaauaagcacgagaugacaaaaauugaucagcaaaacgagaaggaaugccuucugagcguguaugacgagauccuggauaaaauggacaaguaccucucccuguacgauauuaauggguuucggaagaaacuucauguuggcagagacaaguucaucaaacuggaaguggagaagcaggcggaagccaucaaaaacguccuccgcggauuucacgcuaauucugauaugaccaagcugagcgaccucggccuguccacgucucuuggguucaugcaggccagcgauggaauuaagcuguccgacaacgccguguuuaucuaucaaucucccacaggccuguucgagcggagagugaaagucagcgaccuccugaaguga

SEQ ID NO: 4478 - RNA, 4260 nt, Artificial Sequence
  Cas9 variant
augaugaucaagaacauucugggccucgaccuggggaccaauagcaucggaugggcccuuauuaaacagaacuucgagaauaaguacggcgaaauccuggggaugggauccagaauuauccccaugucucaagaugugcucggcgaguuugggaaaggaaacagcgucucccagacagcugcccggacgggcuaucgcggcguuagacggcugcgcgaaagauuccuucugcggcgcgagagacuccaccgggugcugaaugugcugaacuuucucccugaacauuacgcgucucagaucgacuucgagaagcgcuuugggaaauucaaguaugagaccgaaccgaagcuggcuuacaauaacgauggauuuuucuuuaaaaauagcuucgacgagaugcuuggcgauuuuaaggaccaccaguuccaucugcucgaaaacgggagaaaaguccccuaugauuggacaauuuacuaucugcggaagaaagcccuuucccaaaagaucgagaaggaggaacuggccuggauucuccugaauuuuaaccagaaacgcggauacuaccagcugagaggcgaggacuucgaagaggaaaaggaucggguguucguucgccucaaaguggacagagucguggauucuggggagaauaucaagggaaaaauucuguaugacguuuacuuugagaacggcuggaaguaugaaaaacagaucgugaagaccgaggauuggauuggccggacaaaggaauuuaucgucaccgagagcauccuuaaaaauggggacacaaagagaaccuuuaaagcuguggacuccgaaaaggauuggauugccaucaaaacgaagaccgagcaagagauugacaagagccacaaaacagugggagcuuacaucuaugaagcccugcuccagaacccuaagcagaaaauuaagggcaaacugguccgcaccaucgagcggaaguucuacagagaggagcuuaagaaaauccuggaacgccagaaggaguuucaucccgagcuccaaucugaugaccuguauaacgauugcauucgggaacuguacagaaauaacgaggcgcaccagaucacacucuccaaaaaggacuucguucaucugcuucugaaugaucucauuuucuaccagcgcccucugcggagccaaaaaucuuccgugagcaacuguacccuugaguucagaaaguauaaggacgaaaaugggguggagcacgcccaguaccugaaaacgauccccaagucuaacccuuauuaccaggaauuucgcgucuggcaguggauguucaaucucaacauuuaucggaaagaugacgauacaaaugugaccaaggaguuucuguccagcacagaagacuacgagacccuguucgaauuucucaacaauagaaaagagguugaccaaaaggcucugcuucgccacuucaaacugaacgagaagacccaucgguggaauuauguggaagauaagaaauacccgugcaacgagacaaagacgaugaucuccaccagacucgaaaaagucgagaauuaccccucugacuuccugacacgggaaauggagcagaacaucuggcacauuaucuauagcgugaacgauaagauugaguacgaaaaagcccugaaguccuuugcucacaagaauaaccuugacgagaauagcuucuuugaagccuucaaaaaguuuccucccuucaaaucugaguauggauccuuuagcgaaaaggcgaucaaaaagcuccugccucugcuccgccugggcaaguacuggaacugggagucuauugauagaaaaagccaggggcggaucgagaagauuaucaccggagaguucgacggcaauaucaaagauaagguuagagaaaaagccauucaucuuacagcugaaaacgacuuucagggccugcaacucuggcuggcccaguauaucguguacgggcgccacuccgaggcuucuaugauuggaaaguggaauagcgccgaugaccuggaggaguuccuuaagggcuuuaaacagcauucccuccggaaccccaucgucgaacaggugauuaccgaaacgcugagagucgugaaggauaucuggcugaaauaugggaauggagccaaggacuucuuuagcgaaauccacauugaacucggccgcgagaugaaacaaacaaaggaugagagaguugacgcuaccaaacggaucaccgaaaacgagaauacaaaccugcgcauuaaggcgcuucuggccgaaaugaugaaugacaacucuguggagaauaucagaccguacuccccuaugcagcaggaaauucucaagaucuacgaggaugggauccugaaaagcgacauugagaucgaugacgauauucugaagaucucuaaaaccgcucagcccuccagcuccgaccuuaagcgguauaaacucuggcuggaacaacgcuacaagucuccuuauacaggccagauuaucccccugaacaaacucuucacgagcgaguacgaaaucgagcauauuaucccccaguccagauauuucgaugacucuuuuagcaacaaaauuaucugugaauccgccgucaauaagcugaaagauaacuacauuggacuuggcuucaucaagcaauuugggggaaugauuguggagugcggcuucgggaaaagcguugagaucuuuaaggccgaagaguaugaagacuucgugaagaaacacuacgcuaauaaccggucuaagcgcaauaaacugcuccuggaggagaucccugaaaagaugauugauagacagcugaacgacacccggcacaucuccaaauacauuagcggaguccuuucuaauaucgugcgccaggaggauggcacagacgaaggggugaacuccaagaauauuguuccgggcaacggaaagaucaccacacagcucaaacaagacuggggccugaaugaugucuggaacgagcugauccuccccagauuugaacggaugaaucagcugaccaacagcacggacuucaccucuuggaauaagaaccaucagaaauuucuuccuacagugcccauugaguucagcaagggguuuuccaaaaagagaaucgaucaccgccaucacgccauggacgcgcuggugauugcuugugccaccaaggaucacaucaaccuccugaauaaccagagcgccaaaucugacacaaagcgguaugaucugaaaagaaaacuuaugaaguucgagcgcgucguguacucccauagcaagaccggagaaaagauugagaaggaaguuccuaagcaauuccugaaacccugggacaauuuuacgguggaugcuaagaacaaaauggagacaaucaucgucuccuucaagcagaaucuccgggugauuaacaaagccaccaaucacuaugaaaaguggaucgagaaggacggcauuaaaagaaaggagcugaucaaacaggaagggacaaacugggcuauucgcaagccgaugcauaaagagaccguuucuggaaagguggaucucccuggcaucaagauucccaaagggaagauccugaccgccacacggaaaagccuugacacguccuuugaccugaagaccaucaauucuauuacagauaccggcauccagaaaauucucaagaacuaccuggaguucaagggaagcuccgaacuggcguuuucuccugaaggcaucgaggacaugaauaaaaacauugagaaguucaaugaugggaaaccccaccaaagcaucaacaaggucagaaucuuugaacuuggauccaaauucagcgugggccagacagggaauaagaaagacaaguauguugaggccgcuaagggaaccaaccuguuuuucgccguguacgaagauaaaaauggcaagcgcucuuaugagacgauuccucucaacgaggucaucgaacggcagaaacaagggcuggacuccgugagcuuuaagaacaaagaggauuuccuccugugccccaaugaccuuguguacgucccgucugaagaugagcuggaaaacauuuacaauaucgacuuuaagaaccucacaaccgagaagaccggcaauauuuauaaaguuguguccuucagcggaaaccagaucuucuuuaucagacaggauauugcuaucucuauugugaauaaggccgaguucuccacacugaacaaaauggaacgggcgaucgacggcagcaugauuaaggagaauuguaucaaacugaagauugaucgccuugggaacaucgccaagaucuga

SEQ ID NO: 4479 - RNA, 4263 nt, Artificial Sequence
  Cas9 variant
auggccaagcccaaagacuacaccaucggccuggauauugggacaaacagcgugggaugggucguuacggacgaucagaauaacauccucagaauuaagggcaaaaaggcuaucggggcccggcuguucaccgagggaaaaguggcggcugaacgcagauccuuucggacaacccgcagacggcuuucucgcagacgguggcgcauuaagaugcuggaggaacucuucgacgaggaaaucgccaagguggauccuagcuuuuucgccagacugcacgaguccuggaucucuccgaaagacaagcggaaacgcuauagcgcuauugucuuucccuccccugaggaagauaagaaauuccaugagucuuaccccacaaucuaucaccuuagagacaagcugaugaaggaugaccaaaaacaugauauucgggaaaucuacauugccgugcaccagaugaucaaggcucgcggcaauuuucuccaugacgagagcguugagaccuauagauccgggaugagcucucugggaggccgguccgaaagaacaauucugagcgugcagacccucgaggaacugaacgaucuuuucgccgagaaugaaggcacggaggaggucgaacugaacguggcgucugccgagcagaucaaugacauccucaccgggggacaccugaacgcugacucccaaaaagaaauuagcaaucuucugcucccuucuuccuuucccagcuucgaugacaaggccaaagagaagcagguuaaaaagcugaucaacaauguggcuacaaacauuuccaaggccuggcugggcuacaaagcggauuuuucuaccauccucaaucuggccaaggucgacaaagaucagaagaaaauuuucgcuuuugcccuucagggggaagacgaggaggauaaggugcaagaacuggagagccuccuggaacagucccagacagacaucguggaucgccuuaucgagauucggcacgcuaucguccugagcgaaauuguuccugugggaaugacccucucugaggccaugaucgacaaguaugaucagcauaaagaggaccugauuacgcugaaggccgugaucagaaacacaaaagacaagaaaaaggcugcgaagcuccaagccaucuacgaucuguacgucaaaaaucgccacgcugaccuugccaaggccaugaaacugaccggcauuaagaaacgguccgaacuccuggauccggaggaacuuaagaaggggaucagcucucugcucgacgauagccccgaggcuguggagauuaaacagagacuggaagagaagacauuccugccucuccagcgcuccaacaacaauggaguuauccccaaccaacugcaucagguggaacuugacgagauuaucaaaaagcagucuaaauauuacccuuuccuggccgaaaagaaucccgaugagagcgaggaagcgcagaaaaaggcuccgaccaagcucgacgcccugcugaccuuucgggucccuuauuacgugggccccaugauuacaaaagaggaacaagaggcccagaacggccacuccuucgcuuggaugguuagacgcgauccucaggaccacgaagccaucacgcccuggaauuuugagaagaaaguggauaagauggcuagcgccacccaguucaucaaacggaugacaaccaaggacacauaucuucucggggaggauguccugcccgcgucuucccugaaguaccaacucuuuaccgugcugaacgaacuuaauaaccugagagucaauggaaagaagcucacgagcgacgagaaagaacaggugauugagggccuguucaagaaacagaagacaguuaaggccgacaaauuugugaaguauuggcaggcuaaacauaucggggccgauauuaaggucaaaggacugucugacccuuccaaguucaacagcaccauguccaccuacaucgauuuuaagaaaauuuucggcgaccaacuuaaugaugugaaccgccagaaugacuuugaaaagaucaucgaguacucuacaauuuucgaggaucggaaaauccucgaagacaagcugagagcugauuuugccuggcugagcgaggaacagauuaaacagcucugccggcugcgccuucaaggguggggaagacuguccgacaagcuccugacccggcugacagaugcggacggccagaacguucuugagagacucuggaacucuaaugauaacuucgugcagaucgucagcgacccgaauauuaaagccaagaucgagcaagaaaaccagaagcugcugcgcgacucccagagcgauaaugcuguggagucuauccucgacgaugccuauacgagcccccagaacaaaaaggcuauucggcaagugaugagaguuguccacgacaucgugaaagccugugauggcaaugugccugccaaguucgcuauugaauuugcgcgcucccaggaggacgaucccaaaagaaccacagcccgggucaaccagaugcagaagaucuacgaccaaauuucugaugaagugguuucccagggggugaaggagcagcugagcggaaugaaaucucuuaaggaccgcuauuaccuguauuucaugcagggcgggagagaugcuuacaccggagccaaacucaauaucgaccggcugagcgacuaugaugucgaccauaucaugccucaauccuuugugaaggaugacagccuggauaaccgcguucuuguggccagagcugucaauaaccagaaaucugacaaggugcccgcccuccuguucggcaauaagguuguggcggaucuggggauuacaguccgggagaugugggacaaauggcagaagcucggcaugaucuccaaacgcaagcugagcaaccuucugaccgauccggacgcucucacggaauacagagcccaaggauuuauucggcgccagcugguggagaccucccaggugaucaaacugacagccaccauucuucagucugaguucccugauagcaagaucauugaaguccccgcuaaguacaauuccaucguuagaaaacaauuugaccuguauaagucucgggaagugaacgauuuccaccaugccaucgacgcguaccucagcacaauugugggcaauuaucuguaccaggucuauccuaaccucagacgcauguuuguguacggggaguucaaaaaguuuuccucuaacgcugaggaaagcgcccacgacguugcccggagagugaaauccaugaauuuccuggaugaccuucugcgcggaacccacggcgauaacaucuauugccggagcacgggggagauugucuuuaauagaaacgacaucauuucuaagcucaagcaggcuuacuccuucaaacagaugcuggugacacaagaaguuuucacccgcaagagcgcccuguuugaucagacaguguaccccucuccugagcgggacuccaaaaagagaagcggacuuaucccccgcaaaaagggcauggauccggaaaucuaugggggcuacgcucauaaucaggacucuuauuucguccuggccaaaauugagaaggugaagggauacacccuccagaucguuggcgugccuauucggucccuggagaucauuaacaaagcggaagauuuuagcaccgcccuccuggacaucaucaaguccaaagucauguauaaugagaagacagggcaacccaaaagaggaauuaagaacguggaaauccuugugaauaagcugcccuaccggcagccuauucucgagaaagaugucagcuauaugcugggcucuagcgcuuacaaguacaacaugaaacagaucacgcugucccgccagucuaugaaguauauucuugacuacaucgaugacccgaauuucaccaaacacgagaugacaaugauugacgaacaaaacgagagagaaugucugcucagcguuuaugaugagauccuggaaaagguggacaaguaccucccccuguuugaugggaauaaauuccgggagaaacuucauuccgcccgcaaagaguuugugucucugagcgucgacgaugaggcuuccgccaucgaaaagauucugagaggacuccacgccaacucugaaaugccuagccuggagaaucuuaaaaucaagcccgcucugggcuucuuucagaugaagaacgggauuacccucuccaacgacgcggugcugcucuaucagagcccuacaggccuguucgaacggagaguuaaagugucugaucuucugaaguga

SEQ ID NO: 4480 - RNA, 4263 nt, Artificial Sequence
  Cas9 variant
auggccaagcccaaagacuacaccaucggccuggauauugggacaaacagcgugggaugggucguuacggacgaucagaauaacauccucagaauuaagggcaaaaaggcuaucggggcccggcuguucaccgagggaaaaguggcggcuaagcgcagauccuuucggacaacccgcagacggcuuucucgcagacgguggcgcauuaagcugcucgaagaacuguucgacgaagagaucgccaaaguggauccuagcuuuuucgccagacuucacgaauccuggaucucuccgaaggacaaacggaagcgcuauagcgcuauugucuuucccuccccugaggaggauaaaaaguuccaugaaucuuaccccacaaucuaucaccugagagacaagcucaugaaagaugaccaaaagcaugauauucgggagaucuacauugccgugcaccagaugaucaaagcucgcggcaauuuucugcaugacgaaagcguugagaccuauagauccgggaugagcucucugggaggccgguccgagagaacaauucucagcgugcagacccuggaagaacuuaacgaucuguucgccgaaaaugagggcacggaagaggucgagcucaacguggcgucugccgaacagaucaaugacauccugaccgggggacaccuuaacgcugacucccaaaaggagauuagcaaucugcuccugccuucuuccuuucccagcuucgaugacaaagccaaggaaaaacagguuaagaagcugaucaacaauguggcuacaaacauuuccaaagccuggcucggcuacaaggcggauuuuucuaccauccugaaucuugccaaagucgacaaggaucagaaaaagauuuucgcuuuugcccugcagggggaggacgaagaggauaaggugcaagagcucgaaagccugcuugagcagucccagacagacaucguggaucgccugaucgaaauucggcacgcuaucguccucagcgagauuguuccugugggaaugacccugucugaagccaugaucgacaaauaugaucagcauaaggaggaccugauuacgcucaaagccgugaucagaaacacaaaggacaaaaagaaggcugcgaaacugcaagccaucuacgaucuuuacgucaagaaucgccacgcugaccuggccaaagccaugaagcucaccggcauuaaaaagcgguccgagcugcuugauccggaggagcugaagaaagggaucagcucucuccuggacgauagccccgaagcuguggagauuaagcagagaaucgaggagaaaacauuccugccucuccagcgcuccaacaacaauggaguuauucccaaccaacugcaucagguggagcuugacgaaaucauuaagaaacagucuaaguauuacccuuuccuggccgagaaaaaucccgaugaaagcgaggaggcgcagaagaaggcuccgaccaaacucgacgcccugcugaccuuucgggucccuuauuacgugggccccaugaucacaaaggaggagcaagaagcccagaacggccacuccuucgcuuggaugguuagacgcgauccucaggaccacgaggccaucacgcccuggaauuuugagaaaaagguggauaaaauggcuagcgccacccaguucauuaagcggaugacaaccaaggacacauaucuucucggggaagauguccugcccgcgucuucccugaaauaccaacucuuuaccgugcugaacgagcuuaauaaccugagagucaauggaaagaaacucacgagcgacgaaaaggaacaggugaucgaaggccuguucaaaaagcagaagacaguuaaagccgacaaguuugugaaauauuggcaggcuaagcauauuggggccgauaucaaagucaagggacugucugacccuuccaaguucaacagcaccauguccaccuacauugauuuuaaaaagaucuucggcgaccaacuuaaugaugugaaccgccagaaugacuuugagaaaaucauugaauacucuacaaucuucgaggaucggaagauucucgaggacaaacugagaguugauuuugcuuggcugagcgaggaacagaucaagcagcucugccggcugcgccuucaaggguggggaagacuguccgacaaacuccugacccggcugacagaugccgacggccagaacgugcuugaaagacucuggaacucuaaugauaacuucguccagauugugagcgacccgaauaucaaggcgaagaucgagcaagagaaccagaaacugcugcgcgacucccagagcgauaaugccguggaaucuauucucgacgaugcuuauacgagcccccagaacaagaaagccauccggcaaguuaugagagucgugcacgacauugugaaggcuugugauggcaaugucccugccaaauucgccaucgaguuugcucgcucccaggaagacgaucccaagagaaccacagcgcgggugaaccagaugcagaagauuuacgaccaaaucucugaugagguugugucccagggggucaaagaacagcugagcggaaugaagucucuuaaagaccgcuauuaccuguauuucaugcagggcgggagagaugccuacaccggagcuaagcucaauaucgaccggcugagcgacuaugauguggaccauauuaugccucaauccuuuguuaaagaugacagccuggauaaccgcgugcuugucgccagagccgugaauaaccagaagucugacaagguucccgcucuccuguucggcaauaaaguggucgccgaucuggggaucacagugcgggagaugugggacaaguggcagaaacucggcaugauuuccaagcgcaaacugagcaaccuucugaccgauccggacgcgcucacggaguacagagcucaaggauuuauccggcgccagcugguggaaaccucccaggucauuaagcugacagccaccauccuucagucugaguucccugauagcaagauuaucgaaguucccgccaaauacaauuccaucgugagaaagcaauuugaccuguauaaaucucgggaggugaacgauuuccaccaugcuauugacgccuaccucagcacaaucgucggcaauuaucuguaccagguguauccuaaccucagacgcauguuuguuuacggggaguucaagaaauuuuccucuaacgcggaagagagcgcucacgacguggcccggagagucaaguccaugaauuuccuggaugaccuucugcgcggaacccacggcgauaacauuuauugccggagcacgggggaaaucguguuuaauagaaacgacauuaucucuaagcucaaacaggccuacuccuucaagcagaugcugguuacacaagagguguucaccaaaaagagcgcucuguuuaaucagacagucuaccccucuccuaaacgcgauggauccaagcggagcggccuuauccccagaaaacgcgggauggacccggaaauuuauggcggauacgcccauaaccaggauucucacuucgugcuggcuaagaucgagaagguuaaaggcuauacccuccagauugugggggucccuauccggucccuggaaauuaucaauaaggccgaggacuuuagcaccgcgcuccuggauaucauuaaauccaaggugauguacaacgagaaaacaggacaacccaagagaggcaucaagaauguggaaauucuugucaacaaacugcccuaucggcagccuauccucgagaaggacguuagcuacaugcuggggucuagcgccuauaaauacaauauuaagcagaucacgcugucccgccagucuaugaaauacauucuugauuauaucgacgauccgaacuucaccaagcaugaaaugacaaugaucgacgagcaaaaugagagagaaugucugcucagcguguacgacgagauucuggaaaagguggauaaauaucucccccuguuugacggaaacaaguuccgggagaaacuucacuccgcucgcaaggaauuugucucucugagcguggaugacgaggccuccgcuaucgagaaaauucugagaggccuccacgccaauucugaaaugccuagccuggagaaccuuaagaucaagcccgcccugggguucuuucagaugaaaaacggcauuacccucuccaaugaugcuguucugcucuaccagagcccuacaggacuguucgaacggagagugaaggucucugaccuucugaaauga

SEQ ID NO: 4481 - RNA, 4263 nt, Artificial Sequence
  Cas9 variant
auggccaaguucaacaaaaauuacagcaucggccuggacauugggguguccucugucggauaugcuguugugaccgaugacuacagagugcccgccuuuaaguucaaaguccucggcaacacagagaaggaaaagaucaagaagaaucugauugggagcacgaccuuugugccugcgcaguccgcucaaggaacacggguuuuccgcgugaacagacggcgcaucgauagacggaaucaccgcauugccuaucuuagagacaucuuucagaaagagaucgaaaaggucgauaaaaacuucuaccggcgccuggacgagucuuuuagagugcucggcgauaagagcgaggagcugcagauuaaacagccguucuuuggggacaaggagcuugaaaccgccuaucauaagaaauaccccacaaucuaucaucugcggaagcaucucgcugaugccgacaaaaauuccccuguugcugauauucgcgagguguacauggccaucucucacauucugaaguacagaggacauuuccugacccucgaccggaucaaccccaauaacauuaauaugcaaaacagcuggaucgauuuuaucgaauccugccaggaggucuucgaccuggagauuagcgacgaaucuaaaacaaucguggcgauuuuuaaguccagcgauaaucgccaggagaaagugaagaagauccuuucuuauuuccagcaagaacugcucaaaaaggacaaauccauuuucaagcagcugcuucagcugcucuuuggccugaaaaccaaguucaaggauuguuuugagcuggaagaggagccugaccucaacuucagcaaagaaaauuacgaugagaaccuggaaaacuuucuuggcucucuggaggaagacuucuccgaugucuuugccaagcucaaaguucugagagacacgauccuucugagcgggaugcucaccuauacaggaaccacacgggcuagauucuccgccaccaugguggagcgcuacgaggaacaccggaaggaucugcagagauuuaaaucuuucgugaagcaaaaucugagcgagcaggacuaucucgauaucuuuggccgcaagacgcccaacggguucgacgucgacaaagaaacaaagggauacgugggcuauauuuccaauaaaaugguucugaccaacccucagaagcaaaagacaauccagcagaauuuuuacgauuacauuagcgggaagaucaccggaauugagggcgcugaauauuuccuuaacaagaucucugacggcaccuuccugcggaaacucagaacaacggauaauggggccgugccgaaccagauccacgcguacgagcuggagaagauuaucgaccgccaaggagaagauuaucccuuucuucuggagaauaaagacaagcuccuguccauucugaccuucaaaaucccuuacuaugucggcccccucagcaaggggaacaauucucgguuuggauggauuaaaagaacaaucagccaggauauucuggacgauaacgacgaagauacccgcaauggcaagauccggccuuggaacuaccagaaacuuaucaauauggacgagacaagagaugccuucauuaccaaccugaucgggaacgacauuauccuccugaaugagaaagugcugcccaagcgcucccuuauuuaugaagagguuaugcuccagaacgaacugacgcgggugaaauacaaggacaaauacggaaagacacacuuuuucgauucugagcugagacaagaaaucaucaauaaccucuuuaagaccaauaacaaacgggucagcuccgcuaugcugcuugacuaucuggagaauuacaccaaccuccaggccguggagauugucagcggcaucgaaaagggcaaaucucucaauuccacacugaagaccuauaacgaucuuaaaacaauuuucagcgaggaacuccuggacucugagaucuaccagaaggaacuggaggagauugugaagguuaucacgguguuugaugacaaaaaguccaucaaaaauuaucucauuaaguacuucgggcaccuggaauuucuuaacgaggaacgcaucaaucagcugagcaaacucagauauaccggauggggccgguacuccgcuaagcugcugcuugauauuagagacgaggauacaggguucaaccucaugcaauuucugcgcaaugacgaugaaaaccggaaccugucucagcucaucagcgacuccacccugucuuucgauagcgccauuaaguccauccagagcaaaucuacagucgaggacgacguguucgaugagaucaagaaacuugccggauccccggcuauuaagagaggcauccugaauagcauuaaaaucguugacgaacucgugcagauuaucggguacccuccccaaaacauugucaucgagauggcgcgcgaaaauaugaccacggaggagggccagaagaaagccaagaccagaaagacaaaacuggaaucugcucugaagaacaucgaaaauuccgugcuugaaaacggaaaagugccucauagcgaugagcagcuccaaucugaaaagcuguaucuguacuaucuccagaauggcaaagacauguacagccuggauaagaccgggucccccacaccccuuuaucgggaccagcuggaucaguacgagguugaccacauuaucccuuauagcuuucucccgauugauucuaucgacaacaagguccugacccaccgcgagaauaaccaaagaaaacugaauaacauucccgauaaggaaacgguggccaauaugaaaccuuucugggagaaacuuuacaacgccaaacugaucucccagacaaaguaccagcggcucaccacaagcgaacgcacccccgacggagugcugaccgaguccaugaaggcuggcuuuaucgaaagacagcucgucgagacacggcaaauuaucaaacauguggcccgcauucuggacaauagauuccuugauacgaagaucauugcgcugaaaucucagcucaucaccaacuuucggaacacauuccacaucgcuaagauucgcgagcugaaugacuaucaucacgcccaugaugccuaccuggcuguuguggucgggcagacccuucugaaagccuauccuaagcucgcucccgaacugaucuacggacaccacgcccauuuuaacagacacgaggaaaauaaggcgacaauucggaaacaucucuauagcaacaucaugagauucuuuaauaacccggacuccaaggugucuaaagauauuugggacugcaaucgcgaucugccuaucauuaaggagguuaucuacaacagccaggugaauuucgucaaacggaccaugaucaagaagggcgccuuuuauaaccaaaaucccguggggaaauucaacaagcagauugcugccaauaacagauacccucuuaaaacgaagguuuccucucuggacacaagcaucuacggcggauauggccccaugaacuccgcucucagcauuaucauuaucgccgaacgcuucaaugagaaaaaggggaaaaucgagaccgugaaggaauuucacgauauuuucaucauugacuacaagaaauuuaauaacaacccuuuccaguuucugaaugauaccucugagaacggauuccugaagaaaaauaacaucaaucggguccuugcguuuuauggcgugcccaaguacucccugaugcagaaaaacgacgggacaagaaugcuguucgaaagcaagucuaaucugcacaaggccacccaauuuaaacucacaaagacgcagaacgagcuguucuuucauaugcgccggcuucugaccaaauccaaucugauggaucucaagagcgagucugcuauuaaagaaucccagaacuucauccugaagcacaaggaggaauuugacaauaucagcaaccaacuuuccgccuucagccagaaaaugcugggagacacaaccucucucagaaaucugauuaagggcuauaacgagcgcaaaaucaaggaaauugauagcuccgaggaggugaucaaauacuucuaugacaauuuuauuaagauguucucuuuugucaagagcggggcuccgaaaggcaucaacgauuucuuuaacaauaaguacacaguugcccggaugagaccuaaacccgacaagaaauuccucaacgccacccugauucaucaguccaucacgggacuuuacgaaacccggaucgaucugucuaagcugggcgaggacuga

SEQ ID NO: 4482 - RNA, 4263 nt, Artificial Sequence
  Cas9 variant
auggccaaguucaacaaaaauuacagcaucggccuggacauugggguguccucugucggauaugcuguugugaccgaugacuacagagugcccgccuuuaaguucaaaguccucggcaacacagagaaggaaaagaucaagaagaaucugauugggagcacgaccuuugugccugcgcaguccgcucaaggaacacggguuuuccgcgugaacagacggcgcaucgauagacggaaucaccgcauugccuaucuuagagacaucuuucagaaagagaucgaaaaggucgauaaaaacuucuaccggcgccuggacgagucuuuuagagugcucggcgauaagagcgaggagcugcagauuaaacagccguucuuuggggacaaggagcuugaaaccgccuaucauaagaaauaccccacaaucuaucaucugcggaagcaucucgcugaugccgacaaaaauuccccuguugcugauauucgcgagguguacauggccaucucucacauucugaaguacagaggacauuuccugacccucgaccggaucaaccccaauaacauuaauaugcaaaacagcuggaucgauuuuaucgaauccugccaggaggucuucgaccuggagauuagcgacgaaucuaaaacaaucguggcgauuuuuaaguccagcgauaaucgccaggagaaagugaagaagauccuuucuuauuuccagcaagaacugcucaaaaaggacaaauccauuuucaagcagcugcuucagcugcucuuuggccugaaaaccaaguucaaggauuguuuugagcuggaagaggagccugaccucaacuucagcaaagaaaauuacgaugagaaccuggaaaacuuucuuggcucucuggaggaagacuucuccgaugucuuugccaagcucaaaguucugagagacacgauccuucugagcgggaugcucaccuauacaggaaccacacgggcuagauucuccgccaccaugguggagcgcuacgaggaacaccggaaggaucugcagagauuuaaaucuuucgugaagcaaaaucugagcgagcaggacuaucucgauaucuuuggccgcaagacgcccaacggguucgacgucgacaaagaaacaaagggauacgugggcuauauuuccaauaaaaugguucugaccaacccucagaagcaaaagacaauccagcagaauuuuuacgauuacauuagcgggaagaucaccggaauugagggcgcugaauauuuccuuaacaagaucucugacggcaccuuccugcggaaacucagaacaacggauaauggggccgugccgaaccagauccacgcguacgagcuggagaagauuaucgaccgccaaggagaagauuaucccuuucuucuggagaauaaagacaagcuccuguccauucugaccuucaaaaucccuuacuaugucggcccccucagcaaggggaacaauucucgguuuggauggauuaaaagaacaaucagccaggauauucuggacgauaacgacgaagauacccgcaauggcaagauccggccuuggaacuaccagaaacuuaucaauauggacgagacaagagaugccuucauuaccaaccugaucgggaacgacauuauccuccugaaugagaaagugcugcccaagcgcucccuuauuuaugaagagguuaugcuccagaacgaacugacgcgggugaaauacaaggacaaauacggaaagacacacuuuuucgauucugagcugagacaagaaaucaucaauaaccucuuuaagaccaauaacaaacgggucagcuccgcuaugcugcuugacuaucuggagaauuacaccaaccuccaggccguggagauugucagcggcaucgaaaagggcaaaucucucaauuccacacugaagaccuauaacgaucuuaaaacaauuuucagcgaggaacuccuggacucugagaucuaccagaaggaacuggaggagauugugaagguuaucacgguguuugaugacaaaaaguccaucaaaaauuaucucauuaaguacuucgggcaccuggaauuucuuaacgaggaacgcaucaaucagcugagcaaacucagauauaccggauggggccgguacuccgcuaagcugcugcuugauauuagagacgaggauacaggguucaaccucaugcaauuucugcgcaaugacgaugaaaaccggaaccugucucagcucaucagcgacuccacccugucuuucgauagcgccauuaagacaauccaguccaaaagcaccgucgaggacgacguguucgaugagaucaagaaacuugccggaucuccggcuauuaagagaggcauccucaauuccauuaaaaucguugacgaacuggugcagauuaucggguacccuccccaaaacauugucaucgagauggcgcgcgaaaauaugacgaccgaggagggccagaagaaagccaagacaagaaagaccaaacuggaaagcgcucugaagaacaucgaaaauucugugcuugaaaacggaaaagugccucauuccgaugagcagcuccaaagcgaaaagcuguaucuguacuaucuccagaauggcaaagacauguacucucuggauaagacagggagccccacgccccuuuaucgggaccagcuggaucaguacgagguugaccacauuaucccuuauuccuuucucccgauugauagcaucgacaacaagguccugacccaccgcgagaauaaccaaagaaaacugaauaacauucccgauaaggaaacaguggccaauaugaaaccuuucugggagaaacuuuacaacgccaaacugaucucucagaccaaguaccagcggcucacaaccuccgaacgcacccccgacggagugcugacagagagcaugaaggcuggcuuuaucgaaagacagcucgucgagacgcggcaaauuaucaaacauguggcccgcauucuggacaauagauuccuugauaccaagaucauugcgcugaaaucccagcucaucacaaacuuucggaacaccuuccacaucgcuaagauucgcgagcugaaugacuaucaucacgcccaugaugccuaccuggcuguuguggucgggcagacacuucugaaagccuauccuaagcucgcucccgaacugaucuacggacaccacgcccauuuuaacagacacgaggaaaauaaggcgaccauucggaaacaucucuauucuaacaucaugagauucuuuaauaacccggacagcaagguguccaaagauauuugggacugcaaucgcgaucugccuaucauuaaggagguuaucuacaacucucaggugaauuucgucaaacggacgaugaucaagaagggcgccuuuuauaaccaaaaucccguggggaaauucaacaagcagauugcugccaauaacagauacccucuuaaaacaaagguuagcucccuggacaccucuaucuacggcggauauggccccaugaauagcgcucucuccauuaucauuaucgccgaacgcuucaacgagaaaaaggggaaaaucgagaccgugaaggaauuucacgauauuuucaucauugacuacaagaaauuuaauaacaacccuuuccaguuucugaaugauacaagcgagaacggauuccugaagaaaaauaacaucaaucggguccuugcguuuuauggcgugcccaaguacucucugaugcagaaaaacgacgggaccagaaugcuguucgaauccaagagcaaucugcacaaggccacacaauuuaaacucacgaagacccagaacgagcuguucuuucauaugcgccggcuucugacaaaaucuaaucugauggaucucaaguccgagagcgcuauuaaagaaucucagaacuucauccugaagcacaaggaggaauuugacaauaucuccaaccaacuuagcgccuucucccagaaaaugcugggagacaccacaagccucagaaaucugauuaagggcuauaacgagcgcaaaaucaaggaaauugauucuagcgaggaggugaucaaauacuucuaugacaauuuuauuaagauguucuccuuugucaagucuggggcuccgaaagauaucaacgacuucuuuaacaauaaguacaccguugcccggaugagaccuaaacccgauaagaaauuccucaacgccacgcugauucaucagagcaucaccggccuuuacgaaacacggaucgaccuguccaagcugggagaggauuga

SEQ ID NO: 4483 - RNA, 4263 nt, Artificial Sequence
  Cas9 variant
auggccaaguucaacaaaaauuacagcaucggccuggacauugggguguccucugucggauaugcuguugugaccgaugacuacagagugcccgccuuuaaguucaaaguccucggcaacacagagaaggaaaagaucaagaagaaucugauugggagcacgaccuuugugccugcgcaguccgcucaaggaacacggguuuuccgcgugaacagacggcgcaucgauagacggaaucaccgcauugccuaucuuagagacaucuuucagaaagagaucgaaaaggucgauaaaaacuucuaccggcgccuggacgagucuuuuagagugcucggcgauaagagcgaggagcugcagauuaaacagccguucuuuggggacaaggagcuugaaaccgccuaucauaagaaauaccccacaaucuaucaucugcggaagcaucucgcugaugccgacaaaaauuccccuguugcugauauucgcgagguguacauggccaucucucacauucugaaguacagaggacauuuccugacccucgaccggaucaaccccaauaacauuaauaugcaaaacagcuggaucgauuuuaucgaauccugccaggaggucuucgaccuggagauuagcgacgaaucuaaaacaaucguggcgauuuuuaaguccagcgauaaucgccaggagaaagugaagaagauccuuucuuauuuccagcaagaacugcucaaaaaggacaaauccauuuucaagcagcugcuucagcugcucuuuggccugaaaaccaaguucaaggauuguuuugagcuggaagaggagccugaccucaacuucagcaaagaaaauuacgaugagaaccuggaaaacuuucuuggcucucuggaggaagacuucuccgaugucuuugccaagcucaaaguucugagagacacgauccuucugagcgggaugcucaccuauacaggaaccacacgggcuagauucuccgccaccaugguggagcgcuacgaggaacaccggaaggaucugcagagauuuaaaucuuucgugaagcaaaaucugagcgagcaggacuaucucgauaucuuuggccgcaagacgcccaacggguucgacgucgacaaagaaacaaagggauacgugggcuauauuuccaauaaaaugguucugaccaacccucagaagcaaaagacaauccagcagaauuuuuacgauuacauuagcgggaagaucaccggaauugagggcgcugaauauuuccuuaacaagaucucugacggcaccuuccugcggaaacucagaacaacggauaauggggccgugccgaaccagauccacgcguacgagcuggagaagauuaucgaccgccaaggagaagauuaucccuuucuucuggagaauaaagacaagcuccuguccauucugaccuucaaaaucccuuacuaugucggcccccucagcaaggggaacaauucucgguuuggauggauuaaaagaacaaucagccaggauauucuggacgauaacgacgaagauacccgcaauggcaagauccggccuuggaacuaccagaaacuuaucaauauggacgagacaagagaugccuucauuaccaaccugaucgggaacgacauuauccuccugaaugagaaagugcugcccaagcgcucccuuauuuaugaagagguuaugcuccagaacgaacugacgcgggugaaauacaaggacaaauacggaaagacacacuuuuucgauucugagcugagacaagaaaucaucaauaaccucuuuaagaccaauaacaaacgggucagcuccgcuaugcugcuugacuaucuggagaauuacaccaaccuccaggccguggagauugucagcggcaucgaaaagggcaaaucucucaauuccacacugaagaccuauaacgaucuuaaaacaauuuucagcgaggaacuccuggacucugagaucuaccagaaggaacuggaggagauugugaagguuaucacgguguuugaugacaaaaaguccaucaaaaauuaucucauuaaguacuucgggcaccuggaauuucuuaacgaggaacgcaucaaucagcugagcaaacucagauauaccggauggggccgguacuccgcuaagcugcugcuugauauuagagacgaggauacaggguucaaccucaugcaauuucugcgcaaugacgaugaaaaccggaaccugucucagcucaucagcgacuccacccugucuuucgauagcgccauuaaguccauccagagcaaaucuacagucgaggacgacguguucgaugagaucaagaaacuugccggauccccggcuauuaagagaggcauccugaauagcauuaaaaucguugacgaacucgugcagauuaucggguacccuccccaaaacauugucaucgagauggcgcgcgaaaauaugaccacggaggagggccagaagaaagccaagaccagaaagacaaaacuggaaucugcucugaagaacaucgaaaauuccgugcuugaaaacggaaaagugccucauagcgaugagcagcuccaaucugaaaagcuguaucuguacuaucuccagaauggcaaagacauguacagccuggauaagaccgggucccccacaccccuuuaucgggaccagcuggaucaguacgagguugaccacauuaucccuuauagcuuucucccgauugauucuaucgacaacaagguccugacccaccgcgagaauaaccaaagaaaacugaauaacauucccgauaaggaaacgguggccaauaugaaaccuuucugggagaaacuuuacaacgccaaacugaucucccagacaaaguaccagcggcucaccacaagcgaacgcacccccgacggagugcugaccgaguccaugaaggcuggcuuuaucgaaagacagcucgucgagacacggcaaauuaucaaacauguggcccgcauucuggacaauagauuccuugauacgaagaucauugcgcugaaaucucagcucaucaccaacuuucggaacacauuccacaucgcuaagauucgcgagcugaaugacuaucaucacgcccaugaugccuaccuggcuguuguggucgggcagacccuucugaaagccuauccuaagcucgcucccgaacugaucuacggacaccacgcccauuuuaacagacacgaggaaaauaaggcgacaauucggaaacaucucuauagcaacaucaugagauucuuuaauaacccggacuccaaggugucuaaagauauuugggacugcaaucgcgaucugccuaucauuaaggagguuaucuacaacagccaggugaauuucgucaaacggaccaugaucaagaagggcgccuuuuauaaccaaaaucccguggggaaauucaacaagcagauugcugccaauaacagauacccucuuaaaacgaagguuuccucucuggacacaagcaucuacggcggauauggccccaugaacuccgcucucagcauuaucauuaucgccgaacgcuucaaugagaaaaaggggaaaaucgagaccgugaaggaauuucacgauauuuucaucauugacuacaagaaauuuaauaacaacccuuuccaguuucugaaugauaccucugagaacggauuccugaagaaaaauaacaucaaucggguccuugcguuuuauggcgugcccaaguacucccugaugcagaaaaacgacgggacaagaaugcuguucgaaagcaagucuaaucugcacaaggccacccaauuuaaacucacaaagacgcagaacgagcuguucuuucauaugcgccggcuucugaccaaauccaaucugauggaucucaagagcgagucugcuauuaaagaaucccagaacuucauccugaagcacaaggaggaauuugacaauaucagcaaccaacuuuccgccuucagccagaaaaugcugggagacacaaccucucucagaaaucugauuaagggcuauaacgagcgcaaaaucaaggaaauugauagcuccgaggaggugaucaaauacuucuaugacaauuuuauuaagauguucucuuuugucaagagcggggcuccgaaagauaucaacgacuucuuuaacaauaaguacacaguugcccggaugagaccuaaacccgauaagaaauuccucaacgccacccugauucaucaguccaucacgggccuuuacgaaacccggaucgaccugucuaagcugggagaggauuga

SEQ ID NO: 4484 - RNA, 4263 nt, Artificial Sequence
  Cas9 variant
auggccaaguucaacaaaaauuacagcaucggccuggacauugggguguccucugucggauaugcuguugugaccgaggauuacagagugcccgccuuuaaguucaaaguccucggcaacacagaaaaggagaaaaucaagaagaaucugauugggagcacgaccuuugugccugcgcaguccgcucaaggaacacggguuuuccgcgugaacagacggcgcaucgacagacggaaucaccgcauugccuaucuuagagauaucuuucagaaagaaaucgagaagauugacaaaaacuucuaccggcgccuggaugaaucuuuuagaguccucggcgacaagagcgaggauauccagauuaaacagccguucuuugggaauaaggagcuggaaaccgccuaucauaagaaauaccccacaaucuaucaccuucggaagcaucuggcugacgccgauaaaaacuccccuguggcugacauucgcgagguuuacauggugcucucucacauccugaaguacagaggacauuuccugacccucggcaaaauugaucccaauaacaucaauaugcaaaacagcuggaucgacuuuauugaauccugccaggaugccuucgaccuggagaucagcgacgagucuaagacaauugcggccaucuuuaaauccagcgaaaaucggcaggagaaggucaagcagauucuuucuuauuuccaacaggaacugcucaaaaaggauaaauccaucuucaagcagcugcuucagcugcucuuuggccugaaaaccaaguucaaggacuguuuugagcuggaagaggagccugaucucaacuucagcaaagaaaauuacgacgagaaccuggaaaaccuucugggggcucucgaggaagauuuuucugacguguucgccaagcugaaaauccuucgcgauacgauucugcucuccagcaugcugaccuauacaggagcuacccacgccagauuuuccgcgacaaugguggagcgguacgaggaacacagaaaggaccugcaacgcuucaaaucuuuugucaagcagaaucucagcgagcaggauuaucuggacaucuucggccggaagacccccacgggguuugauguugacaaagaaacaaagggauacgugggcuauauuuccaacaaaauggugcuuaccaauccucaaaagcagaaaacaauccagcagaacuucuacgacuacauuagcgggaagaucaccggaaucgagggcgccgaaugcuuucugaauaagauuucugauggcaccuuccucagaaaacugcgcacaacggacaacggggcuaucccgaaucaaauucaugccuaugagcuugagaagaucauugaacggcagggaagagauuaccccuuccugcucgagaacaaagacaagcugcuguccauccucaccuuuaaaauuccuuauuacgucggcccccuggcuaaggggaauaacagccgcuucgccuggaucaaacggacaaccucucaggaugugcuugacgauaaugacgaagauacaagaaacggaaagauccgcccuuggaauuaucacaagcugauuaacauggacgagacccgggaugccuuuaucauuaaucucaucggcaacgacauuauccugcugaacgagaaaguucuucccaagagaagccucaucuacgaagaggugaugcugcagaaugaacugacgcgcgucaaauauaaggauaaauacgggaagauucauuucuuuaacuccgagcuccggcaagaaaucauuaauaaccuguucaagacaaauucuaaaagagugagcuccgcuaugcuucugagcuaccucgagaacuuuaccaaucugcaggcgguugagaucgugucuggaauugaaaagggcaaaucccugaacagcacccuuaagacauauaaugaccucaaaaccaucuucucugaggaacugcuggacuccgagaucuaccagaaggaacucgaggagauuaucaaggucauuacaguguuugaugacaaaaagagcaucaaaaacuaucugacgaaguacuucggccaccuugaauuucugaaugaggagaaaauuaaccagcucuccaagcugcgguauaccggguggggacgcuacucuggcaagcugcuucucgggaucagagaugaagacacaggauucaaucugaugcaauuucugcggaacgaugacgaaaauagaaaccucacccagcugaucagcgauacaacccuuuccuucgacucugccauuaaagcuauccagagcaaguccacggucgaggaugacguguucgaggaaauuaaaaaccuggccggcagcccggccaucaagcgcgggauucucaauucuaucaaaauuguugaugagcuggugcagaucaucggcuauccuccccaaaacauuaucauugaaauggcucgggagaauaugaccacagaggaaggacagaagaaagccaagaccagaaaguccaaacuggagagcgcgcuuaagaacaucgaagacucuguccucgaguccggcaaagugccucacagcgaugaacagcugcaaucugagaagcuguaccucuacuaucugcagaaugggaaagacauguacagccuugacaagacaggaucccccacgccccuguaucgcgaucagcucgaccaguacgagguugaucauauuaucccuuauagcuuucugccgaucgacucuauugauaacaaggugcugacccacagagaaaauaaccaacggaaacuuaauaacauccccgacaaggagacagucgcuaauaugaaaccuuucugggaaaagcuguacaacgccaaacucauuucccagaccaaguaucagcgccugacaaccagcgagagaacccccgauggcgugcucacagaauccaugaaggccggguuuaucgagcggcagcugguggagacgcgccaaauuaucaaacauguugcuagaauccuugacaaucgguucucugauaccaagauuaucacacugaaaagccagcucgucaccaacuuucgcaauacauuccacauugccaagaucagagaacugaacgacuaccaucacgcucacgaugccuaccuggcggugguggucggacagacccuucugaaagccuauccuaagcucgcucccgagcugauuuacggccaucacgcccauuuuaaccggcacgaagagaauaaggcuacgcuccgcaaacaccuguauuccaacaucaugagauucuuuaauaacccggacucuaaggugagcaaagacauuugggauuguaaucgggaccuuccuaucguuaaggaugugaucuacaacucccagauuaauuucgucaaaagaacaaugaucaagaagggggccuuuuauaaccaaaaucccgugggcaaacugaacaagcagauugcggccaauaaccgcuacccucucaaaaccaagguuucuagccuggacaccuccaucuauggaggcuacgggcccaugaauagcgcucugucuauuaucaucauugccgaacgguucaacgagaaaaagggaaaaaucgagacagugaaggaauuucaugauauuuuuaucauugacuacgagaaguucaauaacaauccuuuucaguuccuuaacaacgucuccgaagagggcuuucugaaaaagaaugaucucaacagagugcuggcuuucuaucgcaucagcaaauacucucucaugcaaaagaucgacgggacccggaugcuguuugaguccaaaagcaaucuucacaagguuacacaguucaagcugacgaaaacccagaacgaacuguuuuuccauaugaagagacuccugacaaaaucuaaucuuauggaucugaaguccgagagcgccauuaaagaaucccagaacuuuauccaaacccaccagaaugaguucgacaacauugccgaucgccucagcaauuauucucagaagaugcugggagaaacaaagagccuccagacccugaucaacggcuacaaugagcggcccauuaaacaaaucgacaacaaugaggaaacgauuagauauuacuaugauaacuuuaucaagauguucuccuucgugaaaucuggggcuccgaaggacaucauuaauuucuucaacgacaaauacaccgucccucgcaugcggcccaagcccgauagaaagaugcuugacgcgacacugauccaucagagcauuaccggccuguacgagacacggaucgaucucuccaaacugggagaagacuga

SEQ ID NO: 4485 - RNA, 4263 nt, Artificial Sequence
  Cas9 variant
augagcagaaagaacuacguggacgauuaugccaucucccuggacauuggcaaugcuucugucggguggagcgccuucacccccaacuaccggcucguucgcgcgaaaggacacgagcugaucggcgugagacuuuuugauccugcugacacagccgaaucccggcgcauggccagaacgacccggcgcagauauucucggcgcagauggcggcugcgccuccuggaugcucuuuucgaccaggcccugagcgagauugauccguccuuucucgcuagacggaaguacucuugggugcaucccgacgaugaaaauaacgccgacugcugguaugggagcguccuguucgauuccaaugagcaagacaaacgcuuuuacgaaaaguauccuacaaucuaccaccugagaaaagcgcucauggaggaugacagccagcaugacauucgggagaucuaccuggccauccaccauauggugaaguauagaggaaacuuccuuguugaaggcacccuggagucuuccaaugcuuuuaaggaagaugagcuccugaaacuucuggggcgcauuacacgguacgagaugagcgaaggagagcagaacucugacaucgaacaggaugacgagaauaagcucguggcccccgcuaacggccaacuggccgaugcgcugugugccaccagaggcucccgcagcaugcgggucgacaaugcucucgaagcccugucugcugugaacgaucuuuccagagagcagcgcgccauuguuaaagccaucuucgcugggcuggagggaaauaagcucgaccuggcgaaaauuuuugugagcaaggaguucuccucugagaacaagaaaauccuuggcauuuauuuuaauaagagcgauuacgaagagaaaugcguccagaucguggacuccgggcugcucgaugacgaagaacgggaguuccuggacagaaugcagggacaauauaacgccaucgcucugaagcagcuccugggccgcagcacaucuguguccgauagcaaaugugccucuuacgacgcccaccgggcuaacuggaaucuuauuaagcugcagcucagaaccaaagaaaacgagaaggauaucaaugaaaacuaugggauucuggucggauggaagaucgacagcggccagcgcaaauccguucggggcgagucugccuacgaaaauaugagaaagaaagcgaacguguuuuucaagaaaaugauugagacgagcgaucuuuccgagaccgacaagaaucggcugauccacgauaucgaagaggacaaacucuucccuauucaacgcgauagcgacaacggggugaucccccaucagcugcaccagaaugaacugaagcaaauuaucaagaaacagggaaaguacuauccuuuucuccuggaugcuuucgagaaagacggcaagcagauuaacaagaucgaggggcuucugacauuuagagucccguacuucgugggaccccucguugugccugaagaucugcagaaaucugacaauuccgagaaccauuggaugguccggaagaaaaagggcgaaaucacccccuggaauuuugacgagaugguggauaaagacgccagcgggagaaaguucauugaacgccugguuggaacagauucuuaucuucucggcgagccuacccugcccaagaacucccugcucuaccaagaguaugaagugcugaaugagcuuaacaacguccggcugagcgugagaacgggcaaucacuggaacgacaaacgcagaaugcggcucgggcgcgaagagaagacacugcugugccagagacuuuuuaugaaaggacagaccgucacaaagcggaccgccgaaaaucuccugcgcaaagaguacggcagaaccuaugagcuguccgggcucucugaugaaagcaaguucacauccucucugagcacguacggaaaaaugugucggaucuuuggcgagaaguacgugaacgaacaccgcgaccuuauggagaagauuguugaacugcagaccguguucgaggauaaagagacacuccugcaucaacugagacagcuugaagggaucuccgaggcugacugcgcccuccuggucaauacccacuauacaggcuggggacggcugagccgcaagcuccugaccacgaaagcuggcgaauguaagauuucugaugacuuugccccgagaaaacauuccaucauugagaucaugcgggcggaggauagaaaccuuauggaaaucauuacagacaagcagcugggguucagcgauuggaucgagcaggaaaaucucggagccgagaacgggucuucccugauggaagugguugacgaccugcgcgugagcccuaaggucaaacggggcauuauccaaucuauuagacuuaucgaugacaucagcaaggcugugggaaaacgccccucccggauuuuucucgagcuggccgaugacauccagccuagcggcagaaccauuucucgcaagucccggcugcaggaucucuacagaaaugcuaaccuggggaaagaguucaagggcaucgccgacgaacuuaaugcgugcagcgauaaggaccugcaggaugaccgccucuuccuguauuacacccaacugggaaaagauauguauacaggcgaggaacuugaccuggaccggcucuccucugccuacgauauugaccacaucaucccccaggcugugacccagaacgauagcauugacaauagaguucuggucgcccgggcugagaacgcccgcaagacagauuccuuuacguauaugccccaaaucgccgacagaaugcggaauuucuggcagauucuccuggauaacgggcuuaucucucgcgugaaauuugaaagacugacccggcagaacgaguucagcgagagagaaaaggagcgcuuugugcagcggucccucgucgaaacaagacaaauuaugaaaaauguggcuacccugaugcgccagcgguacggaaacucugcggccguuaucggccugaaugcugagcuuacaaaggaaaugcauagauaccugggguucagccacaagaaccgcgacaucaaugauuaucaccaugcccaggacgcccucugugugggaauugcuggccaguuugccgcgaaccggggguucuuugcugauggcgaggucuccgacggagcccaaaauagcuacaaccaguaucugagagauuaccuccgcggcuauagagagaaacugucugccgaagaccggaagcaggggcgcgcuuucggauuuaucgugggcuccaugagaagccaggacgagcaaaaacggguuaauccucgcaccggggaaguggucuggucugaggaggauaaggacuaccuuagaaaagugaugaacuaucggaagaugcugguuacgcagaaagugggagaugacuucggcgcccucuacgaugaaaccagauacgcggcuacagacccgaaggggauuaagggcauccccuuugauggagccaaacaggacaccucccuguauggcggguucagcucugccaagccugcuuacgccguccugauugaguccaaaggaaagacacgccuugugaaugugaccaugcaagaauauagccugcucggcgaucggcccuccgacgaugagcugagaaaaguccucgcuaagaagaaaagcgaauacgccaaggcgaacauccugcuucgccacguuccuaaaaugcagcugauucgguaugggggaggccugauggugaucaagucugccggcgagcucaauaacgcucagcagcuguggcuucccuacgaggaauauugcuacuucgacgaucugagccaagggaaaggaucccucgagaaggacgaccugaagaaacuccuggauucuauccuuggcagcgugcagugucuguacccguggcauagauuuacggaagaggaacuggccgaccuccacgucgcuuucgauaagcugccugaggacgagaaaaagaaugugauuacagggaucguuuccgcccuucacgccgaugcuaaaaccgcgaaccugucuauugugggaaugacaggcagcuggcggcgcaugaacaauaaguccggguauaccuuuucugacgaagaugaguucaucuuucagagccccuccggacucuucgaaaagagagucaccgugggcgagcugaaacggaaggccaaaaaggaaguuaacagcaaauaccgcacaaaugagaagagacucccuacgcugucuggcgcuucccagcccuga

SEQ ID NO: 4486 - RNA, 4263 nt, Artificial Sequence
  Cas9 variant
auggccaagcccaaagacuacaccaucggccuggauauugggacaaacagcgugggaugggucguuacggacgaucagaauaacauccucagaauuaagggcaaaaaggcuaucggggcccggcuguucgcggagggaaaaguggcugccgaacgcagauccuuucggaccacacgcagacggauuucucgcagacgguggcgcaucaaacuucuggaggaacucuucgacgaggaaaucgccaagguggauccuagcuuuuucgcuagacugcacgaguccuggauuucuccgaaagacaagcggaaacgcuauagcgccaucgucuuucccuccccugaggaagauaagaaauuccaugagucuuaccccaccauuuaucaccuuagagacaagcugaugaaggaugaccaaaaacaugauauccgggaaauuuacaucgcugugcaccagaugauuaagguucgcggcaauuuucuccaugacgagagcguggagacauauagauccgggaugagcucucugggaggccgguccgaaagaaccauccugagcguccagacacucgaggaacugaacgaucuuuucgccgagaaugaaggcaccgaggagguggaacugaacguugcgucugccgagcagaucaaugacauucucacgggggaccaccugaacgcugauucccaaaaagaaaucagcaaucuucugcucccuucuuccuuucccagcuucgacgauaaggccaaagagaaacaggugaaaaagcugauuaacaaugucgcuaccaacaucuccaaggccuggcugggauacaaagcggacuuuucuacaauucucaaucuggccaagguggauaaagaccagaagaaaaucuucgcuuuugcccuucagggcggggaugaagaggacaaggugcaagagcuggaaagccuccuggagcagucccagaccgauaucgucgaccgccuuauugaaauccggcacgcuauuguucugagcgagaucgugccugugggaaugacacucucugaagccaugauugauaaguaugaccagcauaaagaggaccugaucacccugaaggccgucaucagaaacacgaaagauaagaaaaaggcugcgaagcuccaagccauuuacgaccuguacgugaauaaccgccacgcugaucuugccaaagccaugaagcugacaggcaucaaaaagcgguccgagcuccuggacccggaggaacuuaaaaaggcuauuagcucucugcucgaugacagccccgaagccggggagaucaagcagagacuggagggaaaaaccuuccugccucuccagcgcuccaacaauaacggcguuauucccaaucaacugcaucagguggaacuugaugagaucauuaagaaacagucuaaguauuacccuuuccuggcggaaaagaaccccgacgagagcgaagaggcucagaagaaagccccgacaaagcucgaugcccugcugaccuuucgggucccuuauuacgugggccccaugaucaccaaggaggaacaagaggcucaggacgggcacuccuucgccuggaugguuagacgcgauccucaggaccacgaagcuaucacacccuggaauuuugagaaaaagguggauaaaauggccagcgcgacgcaguucauuaagcggaugaccacaaaagacaccuaucuucucggagaagacguccugcccgccucuucccugaaguaccaacucuuuacagugcugaacgagcuuaauaaccugagagucaauggcaagaaacucaccagcgaugagaaggaacaggugaucgaggggcuguucaaaaagcagaaaacgguuaaggcugacaaguuugugaaauauuggcaggccauucauaucggagcugauauuaaggucaaaggccugucugacccuuccaaguucaacagcacaauguccaccuacaucgauuuuaaaaagaucuucggggaccaacuuaaugaugccaaccgccagaaugacuuugaaaagauuaucgaguacucuaccauuuucgaagaucggaaaauccucgaggacaagcugagagcggauuuugccuggcugagcgaggaacagauuaaacagcucugccggcugcgccuucaaggauggggcagacuguccgacaagcuccugacacggcugaccgaugcugacggccagaacgugcuugagagacucuggaauagcaacgacaacuucguucagaucgugagcgauccgaauaucaaagccaagauugaacaagagaaccagaaacugcugcgcgacgggcaguccgaugacgcugucgagagcauccucgaugacgccuauacaucuccccagaauaagaaggccauucggcaagugaugagagugguucacgauaucgucaaggcuugugacggaaacgugccugcgaaguucgccauugaauuugcucgcucccaggaggaugaccccaaaagaacgaccgcccgggugaaucagaugcagaagaucuacgaucaaaucagcgacgaagucgugucucagggcguuaaagagcagcuguccgggaugaaaagccuuaaggaccgcuauuaccuguauuucaugcagggaggcagagaugccuacacaggggcuaagcucaacauugaccggcugucugauuaugacaucgaucauauuaugccucaaucuuuugugaaggacgauucccuggacaaucgcguccuuguggccagagcgguuaacaaucagaaaagcgauaaggugcccgcuuuccucuuuggcaacaaagucguggccgaccugggaaucaccguucgggaaaugugggauaaguggcagaagcugggcaugauuucuaaacgcaagcucuccaaucugcuuacagacccggaugcccugaccgaguacagagcucaaggguucauccggcgccagcucguggagacgagccaggucauuaaacugaccgccacaauccugcaguccgaauuuccugacucuaagaucauugaggugcccgcgaaauacaacagcaucgugagaaagcaauucgaccuuuauaagucccgggaagucaaugauuuucaccaugcuauugacgccuaccugucuaccaucguuggaaacuaucucuaccagguguauccuaaucugagacgcauguucguguacggcgaguuuaaaaaguucagcuccaacgccgaagagucugcucacgauauggcccggagagucaaaagcaugaacuuucucgacgaucugcuucgcgggacacacggagacaauauuuauugccgguccaccggcgagaucguguucaacagaaaugauaucauuagcaagcugaaacaggcuuacucuuucaagcagaugcucguuacgcaagaaguguuuacacgcaaguccgcccuguucgaccagaccgucuaccccagcccugagcgggauucuaaaaagagauccgggcugaucccccgcaaaaagggcauggacacagaaauuuauggaggcuacagcgggaacaaagaugcguauuuugugcuugccgaggcuguuaaggaaaaaggacauacccugcagaucgugggcgucccgauucgggcccucaauacccugaagaacucugcuaauuacuccgagaagcuccuggagaucaucaaaccucaggugauguucaacaagaaaaaugggaagcccaaaaagggaguuaacgacgugcggauucuuauggauaauauccccuauagacaaccuguccuggaaggcggggcccucuacaugcugggcagcuccacauauaaguacagccugaaacagauuacgcuuucucaggagagcaugaaguacauccuggacuauauugacgauccguccuuuaacaaacacaucauggugaauauugaccaucaggaugaaaagaaaugucuccugucuguguacgacgagauccucgauaagauggacaaguaucugccccuuuucgauaucaacggauuucgcaaaaagcugcacgacggcagagagaaauucgucaagcugccuguugaaaaacaagccgagguggugaaggauauucuccgggggcugcacgcuaauagcgaaaugaccaagcccuccgaccuuggacugacaaccgcgcucggcuuuaugcaggccccugaugggaucaaaauuucugacgacgcugucuucaucuaccagagccccacaggacuguuugagcgcagagugaagguuuccgaucuccugaaauga

SEQ ID NO: 4487 - RNA, 4266 nt, Artificial Sequence
  Cas9 variant
augaccaaguucaacaaaaauuacagcaucggccuggacauugggguguccucugucggauaugccguugugacagaggauuacagagugcccgcuuuuaaguucaaaguccucggcaacacggaaaaggagaaaaucaagaagaaucugauugggagcaccacauuuguguccgcccagccugcgaaaggaacccggguuuuccgcgugaacagacggcgcaucgacagacggaaucaccgcauuacauaucuuagagauaucuuucaaaaggaaaucgagaaagucgacaagaacuucuaccggcgccuggaugaaucuuuuagagugcucggcgacaaaagcgaggaucugcagauuaagcagccguucuuuggggacaaggagcuugaaaccgcuuaucauaaaaaguaccccacaaucuaucaucugcggaaacaccucgccgaugccgacaagaauagcccuguugcugauauucgcgagguguacauggccaucucucacauucugaaauacagaggacauuuccugacccucgacaagaucaaccccaauaacauuaauaugcagaacagcuggaucgauuuuaucgaauccugccaagaggucuucgaccuggagauuagcgacgaaucuaaaaauaucgcugauauuuuuaaguccagcgagaaccggcaggaaaaggugaaaaagauccuuccuuauuuccagcaggagcugcucaaaaaggacaaaucuauuuucaagcaacugcuucagcugcucuuuggccugaagacgaaauucaaggauuguuuugaacuggaggaggaacccgaccucaauuucuccaaagagaacuacgaugaaaaccuggagaauuuucuuggcagccuggaagaggacuucucugauguguuugccaagcucaaaguccugcgcgacaccauccuucuguccgggaugcucacauauaccggagcgacacacgccagauucagcgcuaccaugguugagcgguacgaagaacacagaaaggaucugcagcgcuuuaaguucuuuaucaaacagaaccuguccgaacaagacuaucucgauauuuucggccggaagacgcagaauggguuugacguggacaaagagacaaagggauacgugggcuauaucaccaacaaaaugguccugacaaauccucagaagcaaaagaccauucagcagaacuucuacgauuacaucucugggaaaauuaccggaaucgaaggcgccgaguauuuccuuaauaagaucagcgacggcacauuucugagaaaacuccgcacguccgauaacggggcuauuccgaaucagauccaugccuacgagcuggaaaagauuaucgagcggcaaggaaaagacuaucccuuccuucuggaaaacaaggauaaacuccugagcauucugaccuuuaagaucccuuacuaugugggcccccucgcgaaggggucuaauuccagauucgccuggauuaaacgcgcuacaagcucugacauccuggaugacaacgaugaggacacccggaauggaaagaucagaccuuggaacuaccagaaacuuauuaauauggaugagacacgcgacgccuuuaucaccaaccugauuggcaacgauaucauucuccugaaugaaaagguucugcccaaacggagccuuaucuaugaggaagugaugcuccagaacgagcugacgagagucaaguacaaggacaaauacgggaaggcucacuucuuugacuccgaacugcgccagaauaucauuaacggacucuucaaaaauaacucuaagcgggugaaugccaaaagccugaucaaguaucuuuccgauaaccauaaggaccugaaugccauugagaucguuagcggcguggagaaaggcaagucuuuuaacuccacacucaaaaccuacaaugaucugaagaccauuuucagcgaggagcugcuugacucugaaaucuaucaaaaagagcucgaagagaucauuaaggucaucacaguguuugaugacaagaaauccauuaagaacuaccugaccaaauucuuugggcaccuggagauccucgaugaagagaagauuaaucagcugagcaaacuuagauauuccggauggggccgguacucugcuaagcugcuccuggacauccgcgaugaagacacaggguucaaccugcuucaguuccucagaaaugaugaggaaaaccggaaccugacgaaacugaucagcgacaauacccucuccuuugagccgaagauuaaggauauccagucuaaaagcacaauugaggacgacaucuucgaugaaauuaagaaacuggcgggauccccugccaucaagagaggcauucuuaacagcaucaaaaucgucgacgagcuggugcaaauuaucggguaucccccucacaauauuguuaucgaaauggcucgcgagaacaugaccacagaggaaggccagaagaaggccaaaacccggaagacgaaacucgagucugcccugaagaauauugaaaacucccugcuugagaauggaaaagugccccauagcgaugaacagcuccagucugagaagcuguaccuguacuaucuccaaaacggcaaggacauguacacccuggauaaaacagggucccccgcuccucuuuaucuggaccagcucgaucaguacgaggucgaccacaucaucccguauagcuuucugcccauugauucuaucgacaauaaggugcugacccauagagaaaacaaucaacagaaacuuaacaauauuccugauaaggagacaguugccaacaugaaacccuucugggaaaagcuguacaaugcgaagcucaucagccagaccaaauaucagcgccugacgacauccgagagaaccccugacggagugcucacagaaagcaugaaggcuggcuuuauugagcggcaacuggucgagacccgccagaucaucaaacacguggcccggauucuugacaacagauucucugauaccaagaucauuacacugaaaucccagcucaucacgaacuuucgcaauaccuuccauauugccaagaucagagaacugaacgacuaccaccacgcucaugaugccuaccuggcugugguugucgggcagacacuucugaagguguaucccaaacucgccccggagcugauuuacggacaccaugcgcacuuuaaucggcacgaagagaacaaggccacccuccgcaaacaucuguauagcaauaucaugagauucuuuaacaauccugacuccaaggugucuaaagauaucugggacugcaaccgggaucuucccauuaucaaggacgucauuuacaauagccaaaucaacuucgugaaacgcacaaugauuaagaagggcgcuuucuauaaucagaacccuguugggaaauuuaauaagcagcuggccgcuaacaauagauacccccucaaaaccaaggcccugugucuggauacguccaucuauggcggauacggcccuaugaacucugcgcuuagcaucauuaucauugccgaacgguucaaugagaaaaaggggaagaucgagacagugaaagaauuucacgacauuuucaucaucgauuacgagaaguuuaacaacaaucccuuccaguuucugaacgacaccuccgaaaauggauuccucaaaaagaacaauauuaacagaguccugggcuuuuaucgcaucccgaaauacucucucaugcaaaagauugaugggacccggaugcuguucgagagcaaguccaaucuucauaaagcuacacaguuuaagcugaccaaaacacagaacgagcuguucuuucacaugaagagacuccugacgaaaagcaaucuuauggaccugaagucuaaguccgccaucaaagaaagccaaaacuucauucucaagcauaaagaggaguucgacaauaucucuaaccagcuguccgcuuuuagccagaagaugcucggaaauaccacaucucugaaaaaccuuauuaagggcuauaaugaacgcaaaaucaaggaaaucgauauucgggacgagaccaucaaguacuucuaugauaacuuuauuaaaauguucuccuuugugaaguccggggccccuaaagacaucaacgauuucuuugacaauaagugcacaguugccagaaugcgccccaaacccgauaagaagcugcugaacgcuacccucauucaccaguccaucacgggccuguacgagacccggaucgaccuuagcaaacugggagaagauuga

SEQ ID NO: 4488 - RNA, 4266 nt, Artificial Sequence
  Cas9 variant
augaagaaaauccugggccucgaccuggggcccaacagcauuggaugggcccuugugaaugaggcugaaaacgagaaugaaaaguccucuaucauuaaaaucggcagcagagucauucacuacggggauaaccugguuaagguggacaaauccggaaagaucucugccagcaugaccccugaggaagauuucuccucuggcaaggggcucagcccgaaugcgggacggacaaaacagcgcuccgcuagacggaaccugcaacgcuauaagcagagacggaauaaccuuaucgagauucugaaagcccauagccucaucgacaauaacuuuauuuucucugaggaaggcaaugagacgaccuuuaagacauacaaaaaccgcgcccuggcugccaccaaugaaaucucccuggaggauuucauuaaggugcucuuuaugaucaacaagaaaagaggcuauaagagcucucggaaagcuaagggggacgaggauggacagcugauugacggcauggccaucgcgauccagcuuuacgaacacaaucaaacacccgggcaguucgucuauaaccugcucaaaaacggaaagaaaaauauuccugauuuuuaccgcuccgaccugcagaccgaguucgauagaaucuggaacuuucagaaggccuuccaucaagaaagccuuucugacggcauuugcgagaagcugguggggcagaaaaagaauguuacauccgcuauccucuuuaaagaguucaagauugaaagccuggagaucaaaggaaagugggaugaaaagcgguuuuuccgcuaugagcugagaaacaaagccgugcagcaggaacucaagcugaaugagaucgcugaaugucuugucgagauuaacggcgagaucuccaauucuagcggcuaccugggggccauuuccgaccggagcaaagaacucguguuccaaaagaucaccguuggacaguaccuguauaaacagauugcggccaaccccaauacgucucuuaagaagcaaaucuuuuaccgccaggacuaucuggaugaguucaacacccucugggaaacacaggcuaaauaccacaaggagcugaccgacgaacugaaaacacagaucagagaugugauuaucuuuuaucaacggagacucaagucccagaaaggccugauuagcuucugcgaguuugagucuaagcagaucgaagucuucguggacgggaagaaaagcauuaagacccgcggaaugcgggugaucccuaaauccucuccccuuuuucaggaguucaagauuuggcaaauccugaauaacaucgaaauuacggaucucaaaacaaaggagagcagagagcugaccgacgaugaacgccagcuucuguuugaggaacucaauauccggccuaaaauuuccaagaaggaggcccugaaaauccugacagaaaagccggcucaguacgaccucaacuauaaagauauugagggcaauaagaccaacgccaaauucuacgaggccuacaacaagaucauccaucugagcgggcacgacgaaauugauuuuaccgacaagacaucugacaucaaugaguaucuuaaacagauuuucucccugcucggaaucaagcccgaaauucuggauuuugacagcucucugaaagaugaggacuucgaaaagcaacuucacuuccagcucuggcaucugcuguacuccuuugagggcgauaacacgaaaaccggcgacgagaagcuccugcagaaacuuaauacaaaguucggguuuccugucgaauaugcuaagguuaucagcaacaucgcgcugcccgaugacuacggaucccucucugccaaagcuauuagaaagauccugccucaccugaaagauggcuucagcuaugggggacgcaagucccggcccgacgagccgucugccugugaauacgccggcuauagacauagcaaggcuucccuuaccaaagaugagaaggaaaauaaaacauacaaggacaaacucgagauucugccuaagaacagccugcgcaaucccaucguggagaaaauucucaaccagaccaucaauguggucaacgccgugaucggggauuacggcaagccugacgaaauucggcuggagcuugcgagagaacugaagaaaucugcugaggagcgccaagacgccacggauuccaucagcaaggccacagcuaaacacgaaaaguaucggaaaguucuccagaccgaguuuggacugaagcacauuucuagaaaugaccugauccgguacaaacuuuaucucgaacugaagaacaauggcuucaagacccuguacuccgauacauauauugcccccuacgagaucuuuagcaaaaaguucgacauugaacauauccuccccaaagcuaagcuguuugaugacucuuucagcaacaagacccuugagcugaaauccgugaaucucaagaaaggggauaugacagccuaugacuuugucaaggaggaauacggaacggagggccuggcgaaauacgaacagcgcgugcaagaucuguuccuuaacaagaagagaaacgaggaccucgaucaggaaaaugagagccggaucaccgacgagaaaauuucuaagacaaaaagagauaagcugcugaugccugaaaacaaaaucccgaccggguuuauugaccgcgagcuccgggacucccaguauaucgccaagaaggcuaaaacaaugauggaagauauuugcaaggacguugugaccacgaccggaagcgucacagauagacugcgcgaggacuggcagcuuaucgauaucaugcaagaacugaauuggcccaaauacgccgcucucggccugaccgaggaguucacaaacgaagaggggaaugugauuagaaagaucaaagacuggaccaagcggaacgaucaccgccaucacgccauggacgcgauuacgaucgccuucacaaaaagaucccauauucaguaucugaauaaccuuucugcucggagcgauaaguccucuagcaucuacggcaucgaacagaaggagcuguaucgcgacaaaaauaacaagcucagauuugccccucccauuccuaucaaugaguuccgggcugaagccaaaaugcagcuggagaacacccucauuuccaucaaggcccaaaauaaagucgugacaaagaacaagaauaaaauuucuggacagaagaaacugcaggaaacccuuacaccccgcggccagcugcaccucgagaccaucuacgggaagauuaaccaauaucagacggcugaaaucaaaguuggaggcacccuggauagcgagcugaucaacaagguggcgaauaagaaaacaagagaggcccuucugaaccggcucgcugaauuugggaaugacccgaagaaagccuucaccgucaagaacacaauugacaaaaauccuaucuaccuggauaagcaccaguccuacaagauucccgagaaagugaagaucguuuggcaagaaccuguguauaccauucgcaaaagcaucacgcccgaccucaagcuggauaaaaucauugacccuaagaucaaagcccuucuggagucuagacucaaggaauguaacggagaugcuaagcuggccuuuuccaaucuggcggagaaccccauuuggcuuaauaaagagaagggcauccagauuaaacgggucacaaucaccgggaucagcaacgcugccucucugcaugacaagaaagaucucaauggcaagccgauucuggacgaaaagggaaacaaaaucuccguggauuucgugaauaccggcaacaaucaccauguugccauuuacaaggacgagaacgggaaucuccacgauaacgucgugacauuuuucgaagcuguggagagagucaaccagaaucugccugugguugacaaacuuuuuaagcagaaagaaggauggcaauuccuguuuaccaugaagcagaacgaguauuucguguuccccaaugagaucacagccuuuaaccccaaugaguucgaucugcucaacccugacaauuacuaucugauuagcccgaaccuuuuucgcguccagacgaugucuaaggugauguacggcaauaacacccugcgggacuauaaauucagacaccaucucgaaacaacccugcaggauaucaaggaacuccgcgacauuguuuuuaaacaauucaagucccugagcaucuuugauaaaaucgugaagguccggauuaaucaccuugggaagaucgugaaaacaggagaguacuga

SEQ ID NO: 4489 - RNA, 4266 nt, Artificial Sequence
  Cas9 variant
augaaggacauccugggccucgaucuggggaccaacagcauuggaugggccguggucaaagaggcucagaaugacaacgaacaauccgagaucguugaugugggcgugagagucaauccccuuacaacggacgaaaagaccaacuucgagaaagggaagccuauuucuacaaaugccgaucggacccugaaacgcagcgcgagacggaaccuccagcgcuacaagcugagacggaaggaacuuaucgagcugcucaaagagcaccagcugauuuccacagacaccauccugacagaaaauggaaagggcaccacguuucagacccucgagcugcgcgcuaaaucugccaaggagaaaaucagccuugaggagcuggccagaguguuccucacaauuaacaagaagcggggguauaaauccucucgcaaggcuaaaaaugaagaugagggacaacugaucgacggcauggaaauugccaagagacuuuacgaggaaaaccugaccacaggccagcucagccugcagcugcucaaagaggggaagaaaucccugccggauuauuaccggagcgaccuucaguuugagcuggauaagguuuggaauuuccaaaagcaguuucauucucacauccucaccgacgaauuuuaugcucagcugaaaggaaagggccagcgcgccacguccgcgcuuuuucuggccaaauaccaaauuuauacagcugagaacaaggggagcagagaagauaaaaagcuccaggccuaccaguggcggguggacgcucugucuaaggagcugacccgcgaacaacucgccuucgucaucacagagauuaauaacaaucugaacaacuccagcggauaccuuggcgcgaucucugacagauccaaagagcuguauuuuaauaacgaaaccgugggggaguaccucuggaagcagaucgccgcuaauccccauaccagccugaaaaaccagguuuucuaucggcaggauuaccuugacgaauuugagcaaauuuggaagacacaguccgccuucuauccugaaauccugacggagucucucaaaaaggagcugagagauguggucauuuucuaccagcgcaagcugaaaagccagaagucccucgugagcuucugcgaguucgaaaauaaagaaaucgagauuaagaaagaggacggaaccucuacaaagaaggugaucggccugaaagucgcucccaaguccagcccucuuuuucaagaguucaaaaucuggcagaaccugaauaacguucucauucggaagaaaggcucuaagaccaaaaaggccgccaagaaucagcaggcugugcuguuugaagaagagaaaacaaucagcgaacuggaucuugaggcgaagcaagcccucuucaacgagcugaaucugaaagggaaccucaaggcugacuauugucuggaaauucuuggauacucccccaaagagugggaaaugaauuacucugugcuggagggcaacagaaccaauaaggcccucuaugaagccuaccugaagaucacggaucuggagggguaugacgcuaaaaaccaccuuaaggucaaacucaacaaggaugagguggaacuggacgaucugaaaguuccugccagcgagauuaaggacauggugcaggcgaucuuuaaggaagcuggaaucaauacagacauucuccauuucaacgccgagcuggauggcaaagacuuugaaaaucaggccuccuaccagcuuuggcaucugcucuauagcuacgagggggaugacucuaaguccggaaacgagcugcuguauaaacuucucgaaaccaaguucggcuuuaaaaaggaguacgcucaaauccuggccaaugucagccugucugaugacuacggcucccucagcaccaaggcuaugcgcaaaauucacccguauaucaaggaaaacaaauucuccacagccugcgagcuggcgggguaccggcacucuaagcacagccuuaccaaagaggaaaaugauaacagagugcugcgcgacucccucgagguucugaagaaaaauucucugcggcagcccguggucgaaaagauucuuaaccagaugaucaaucucgugaacgcccugcugaagaaauauagaacagagaauccuaacuuuaaguucgaugaaauucgcaucgagcucgcucgggagcugaaaaagaaugccgaagagagagcuaacaugacggccaacaucaauaaagcgaagaccgaacaugagaagauuaucaaaauucuuaagaacgaauuuggacugcccaauccuacacgcaacgacaucauucgguacagacucuaugaggagcugaaagccaauggcuacaaggaucuguauaccaacaucaaaaucccccaagaaaaacuuuucacaaaggagauugacaucgaacacauuaucccgaaaagccgggucuucgaugacuccuuuagcaauaagacccugucuuuccgcaaaacgaaccucgacaagggggagagaaccgcuuuugauuacauggaauccaaauucggagccgacaagcuggaggaguacguggcucggguugaagaucucuauaagaauaacauuaucagcaaagccaaguaccagaaacugcuuaagaaagagucugaaaucggcgacggguuuguggagagagaucugcgcgagacacaguauauugccaagaaggcuaaagaaauccuccugcagauuaccccuaauguccuguccacaagcggcggaaucaccgaccggcuuagagaggauugggaccugauuaacgugaugaaggaacucaaucugcccaaauaccgcgcgcucggccugacggagauggaagauagaaaguaugggcaacagguugaggugaucaucgacuggacaaaacggaacgaucaccgccaucacgccauggacgcucuuaccgucgccuucacaaagcauaaucacauucaguaccugaacuaucucaacgccagaaagaaugagaagcauaaggaacacucuaacaucaugggcauucagcaacuggagaccaucaaagugaccgauaagaauggaaacgaaaaacggguguuuaaggcuccuaugcccaauuuccgccagguuacaaaagccuuucuggagaacauucuuaucagccacaaggcgaagaauaaagucgugacgaagaacaaaaauaagguggcuggguccaacaaaguccaggaagugcugacccccagaggacagcuccauaaggagacaguuuacggcaaguaccaauauuacgugcagaaagaggaaaagauugggggcaaauucgaccuggagaccaucaagaaagucgccaauccucucuaucagagccugcuuaagaagcggcuggaagagaacggaggcgacccgaaaaaggccuuuacagggaaaaauucucuggcuaagaaccccaucuaccucgaugacgcccaaaccgaacagcugccugagaaagugaaacuuguuuggcuggaaaauuccuucagcauucgcaaagauaucacgcccgaaaacuuuaaggacgagaagcucauugauaaaauccuggacgaaggagugaagcggauucucaaagagagacugcaguccuucggcaaugaugcgaagaaggcuuucucugaccuugagaagaacccuaucuggcugaacaaggaaaaagggaucacaauuaagcgcgucaccaucagcggaguggccaaugccgagccccugcacaccaaaaaggaucaucucggcaaagaaauucuggacaaggaggggaagccgaucccuguugauuuuauuuccacaggcucuaaccaccacguggcugucuauagagacgaaaaaggaaaucuucaggagaagguggugagcgucuucgaggccguugugcgggcuaaccaaggccugcccaucaucgacaaaaccuacaaucagcaucucgggugggaauuucuguucacaaugaagcagaacgagauguuuguguucccuaaugaauccacgggauuuaaccccaaugauauugaccuccuggauccuaaaaacaagagaaucauuucucccaaucuuuuccgcguccagaagcuggccaccggcgacuauugguuucggcaccaucuggagacaaccguggaaacaaaaagcgcgaccaaggauaugacguacaaaagacucucccugaaccacaucaagaauauuaucaaaguucgcauuagccaucuuggggacaucgugucugucggagaguacuga

SEQ ID NO: 4490 - RNA, 4275 nt, Artificial Sequence
  Cas9 variant
augaagagaauccugggccucgaccuggggaccaacagcauuggaugggcccuugugaaugaggcugaaacagaugaggaagucuccucuaucauucggcugggcguucgcgugaacccccucacgguggacgagacccagaauuucgaaaaagggaaaagcaucacaaccaacgccgagagaacacugaaacgguccaugcgcagaaaucuucaacgguacaagcugcgcagagaugcgcucgucgaguuucugaaagaacugggauucauuaccgacgagacaauccucucugaacagggcaaccggaccacguuugagaccugccgccugagagcuaaggccgccgaggaagagaucagccuugaagaacugucccgggugcuccugaugauuaauaagaaacgcggguauaagucuagcagaaaaguuaagaaagaagaggauggagugcuuaucgacggcauggagauugcuaagaagcuguacgaagaggaucucacaccuggccagcuguguucccagcugcucgaaagcgggaaaaagguccugccggacuucuaucggucugaucuucaagaggaacuggaccgcaucugguccgugcagaaacaguuucaccccgauguuuucugcgacgccgcuaaggaggagauuaaaggaaagaacagaagccagaccugggccauccucgcgaauuacuuuguguggaaagaagaggucgugggcuggaacgaucgggaagccaagaaugagacaauugaaaaggaguguaaacugguggggcuuaagagaaccacgaaaggauaugagcugaagaaagaaaacuaccgcuggcgggcucaagcccucacagagcagcugggccuggaagagaucgcugucguucuccaggagaucaaugggcagauuaacgccucuuccggauaucugggcgcgaucagcgacagaucuaaggugcuuuacuucaaucaucaaaccgugggccaguaccagauggccgaacuggacaagaacccucacgcuucccuccgcaacauggucuuuuaucggcaagauuaccuggacgaguucgauagaauuugggaaaaacaggccgaguuucauaaggaacuuacagcugagcugaaaaaggagauccgcgacaugauuaucuucuaucagcggagacucaaaagccagaaggggcugaucuccuuuugcgaguucgagcgccuggaaauugugguugagaaggaugggaaaaagcaaaccaaagugaucggcuguaaggucauuccccggucucacccucucuuccaggaauuuaaaguguggcagacccugaaugacaucaagguucuugggagagagaagaaacgcaacgcccugagcgccuccgagagccgggcucucuaccccgaagagaaggaaauucuggcgagagagcuggccaucaaagaaaauaugaagaaagcugaugugcuuaagcuccuguucgagaacccucaggagcuggaccucaauuuuaaacaaaucgauggaaaccggacaggcuucucucuguuuuccgccuauagcaagaugauugaaaaguacggguaugagccgcuugacuucaaaaagcccgccgaugaaaucauuggacagcugcgcacgaucuuuaccgaccucggcuggaauacaaaccuguucaccauugaccugacaaaagagggcaaggagcuugaaaugcagccuuacuuuagacucuggcaucugcuguacucuuucgagggggauaauaccagcacgggaaacggcaaacucaucgaaaagauuaugcagcugugcggggucgagaaggaauaugcuguggagcuugccucccugucuuuucaagacgauuacggaagccucuccgcgaaagcuaucaagcggauccugcccuaucugaaagagggcaaucuuuacgacgucgccugugaauaugccggguacagacacagcaagucuucccucacaaaagaggaaauugagaacaaggugcugaagggcaaacuggaaguucucccuaagaauagccugcgcaaccccguggucgagaaaauccuuucucagauggugaauguuauuaacaccaucauugauaccuauggaaagccggacgagauccggguggaacuggcuagagagcucaaaaaguccgccaaggaacgcgaggaacugacaaaagcuaucgccaagagcaccagagagcacgaggaaauucggaaacugcuucaggaugaguucggcaugaugaacgucucccgcaaugacaucauuagauacaagcucuacgaggaacugaaagauaacggguauaagacacuguacucuaaucaguauaucccuaaagagaagauuuuuagcaaggaaaucgacaucgagcauauuaucccccaaucccgccucuucgaugacucucugagcaacaaaacgcuugaauacaaggcgauuaauaucgagaaaggaaacaagaccgccuaugauuucgugaaagaaaaguacggcgaggaggggcugcagcaguauauuaaucggugcgaaucccucuuuaacgacaagaaagcuaagcugagaaaacugaagauggagcaaaaagacaucccugauggauucaucgaccgggaucuucgcaauacacaguacauugccaagaaggcucuggccaugcucaacgaaaucuguagacgggugguugcgaccacaggcagcauuaccgaccagcugcgcgaggauuggcagcucgucgacgugaugaaagaacugaaucuucccaaguacgaggcccugggguuuguggagacguaugaagauaaagacggcagaaagaucaaacggauuaaggauuggaccaagagaaacgaccaccgccaucacgcuauggaugcccucacagucgcuuucaccaaagacgccuuuauccaauacuucaauaacaagaaugccgcucaggauucuggaaaccggaaccacacaaauauuaucggcaucaaaaccagauauuuugacaaggggcgcgcgcugcccccuauuccgcuggagcaguuccggaucgaagccaaacagcaucuugagaagcugcucguguccauuaaggcuaaaaacaagguugugacggucaaugugaacagaaccaaaaagcgcaaaggagaaaauacaaagauccaacagacaccccggggccagcugcaccucgagaccguuuacgggagccauaaacaguaugugaccaagauugagaaggucaacgccucuuuugacgccgcuaaaaucgccacaguguccaagagagcguaccgcaaugcucugcuuaaacggcuggaaacguucggaaacgauccuaagaaagccuuuaccggcaagaaugcccucgagaagaacccccuguaugcugacaaauaccaaacaaucagaguuccugaaaaggugcagaccgucgaguucgagacaauuuacaccauccggaaacccguggauccggcccugaauguggacaaggucguugaugugaaagugcgcgcgauucuugaaagacggcugaaggaguaugggggcgacccuaagaaggcuuuugucaacuucugggaaaaucccaucuggcucaacaaggagaaaggaauuagcaucaagcgcgugucuaucagaggcauuaauaacgcccagagcauccacguuaaaaaggauaagaacgggaauccuauuugggacgaaaacggaaaacaaauccccguggauuucgucaauacgggcaacaaucaucacguggccauuuaccggaagccuguucuggacaaaaagggacaggugacauuugaugaggacggaaaccucauguaugagcuggacgaagucgugguucccuucuuugaggcugugaccagagccaaucuuggccugccgaucauugauaaagacuaccgcaaguccgaaggguggcaguuccuguuuagcaugaaacagaacgaguauuucgucuuuccuaaugaaaagaccggcuucaaccccaaggagguggaucuccugaaucccgacaacuacgcuaugaucucuccuaaucuuuuucgggugcaaacaauguccaaagucauguauggaaacaauguugugagagauuacaaguuccgccaccaucuggagaccacagugaaagacaugaaggaacucaaagauaucgccuacaagcaguauaagacgcugagcuuuggcaacuccgucgugaaaauucggaucaaucacauugggcagaucguuucugugggagaguacuga

SEQ ID NO: 4491 - RNA, 4275 nt, Artificial Sequence
  Cas9 variant
augaagagaauccugggccucgaccuggggaccaacagcauuggaugggcccuugugaaugaggcugaaacagaugaggaagucuccucuaucauucggcugggcguucgcgugaacccccucacgguggacgagacccagaauuucgaaaaagggaaaagcaucacaaccaacgccgagagaacacugaaacgguccaugcgcagaaaucuucaacgguacaagcugcgcagagaugcgcucgucgaguuucugaaagaacugggauucauuaccgacgagacaauccucucugaacagggcaaccggaccacguuugagaccugccgccugagagcuaaggccgccgaggaagagaucagccuugaagaacugucccgggugcuccugaugauuaauaagaaacgcggguauaagucuagcagaaaaguuaagaaagaagaggauggagugcuuaucgacggcauggagauugcuaagaagcuguacgaagaggaucucacaccuggccagcuguguucccagcugcucgaaagcgggaaaaagguccugccggacuucuaucacucugaucuucaagaggaacuggaccggaucugguccgugcagaaacaguuucaucccgauguuuucugcgacgccgcuaaggaggagauuaaaggaaagaaccgcagccagaccugggccauccucgcgaauuacuuuguguggaaagaagaggucgugggcuggaacgauagagaagccaagaaugagacaauugaaaaggaguguaaacugguggggcuuaagcggaccacgaaaggauaugagcugaagaaagaaaacuacagauggcgcgcucaagcccucacagagcagcugggccuggaagagaucgcugucguucuccaggagaucaaugggcagauuaacgccucuuccggauaucugggcgcgaucagcgaccggucuaaggugcuuuacuucaaucaccaaaccgugggccaguaccagauggccgaacuggacaagaacccucaugcuucccucagaaacauggucuuuuaucgccaagauuaccuggacgaguucgaucggauuugggaaaaacaggccgaguuucacaaggaacuuacagcugagcugaaaaaggagaucagagacaugauuaucuucuaucagcgccggcucaaaagccagaaggggcugaucuccuuuugcgaguucgagagacuggaaauugugguugagaaggaugggaaaaagcaaaccaaagugaucggcuguaaggucauuccccgcucucauccucucuuccaggaauuuaaaguguggcagacccugaaugacaucaagguucuugggcgggagaagaaaagaaacgcccugagcgccuccgagagccgcgcucucuaccccgaagagaaggaaauucuggcgcgggagcuggccaucaaagaaaauaugaagaaagcugaugugcuuaagcuccuguucgagaacccucaggagcuggaccucaauuuuaaacaaaucgauggaaacagaacaggcuucucucuguuuuccgccuauagcaagaugauugaaaaguacggguaugagccgcuugacuucaaaaagcccgccgaugaaaucauuggacagcugcggacgaucuuuaccgaccucggcuggaauacaaaccuguucaccauugaccugacaaaagagggcaaggagcuugaaaugcagccuuacuuucgccucuggcaucugcuguacucuuucgagggggauaauaccagcacgggaaacggcaaacucaucgaaaagauuaugcagcugugcggggucgagaaggaauaugcuguggagcuugccucccugucuuuucaagacgauuacggaagccucuccgcgaaagcuaucaagagaauccugcccuaucugaaagagggcaaucuuuacgacgucgccugugaauaugccggguaccggcacagcaagucuucccucacaaaagaggaaauugagaacaaggugcugaagggcaaacuggaaguucucccuaagaauagccugagaaaccccguggucgagaaaauccuuucucagauggugaauguuauuaacaccaucauugauaccuauggaaagccggacgagauccgcguggaacuggcucgggagcucaaaaaguccgccaaggaaagagaggaacugacaaaagcuaucgccaagagcacccgcgagcacgaggaaauuagaaaacugcuucaggaugaguucggcaugaugaacgucucccggaaugacaucauucgcuacaagcucuacgaggaacugaaagauaacggguauaagacacuguacucuaaucaguauaucccuaaagagaagauuuuuagcaaggaaaucgacaucgagcacauuaucccccaauccagacucuucgaugacucucugagcaacaaaacgcuugaauacaaggcgauuaauaucgagaaaggaaacaagaccgccuaugauuucgugaaagaaaaguacggcgaggaggggcugcagcaguauauuaaucggugcgaaucccucuuuaacgacaagaaagcuaagcugcgcaaacugaagauggagcaaaaagacaucccugauggauucaucgacagagaucuucggaauacacaguacauugccaagaaggcucuggccaugcucaacgaaaucugucgcagagugguugcgaccacaggcagcauuaccgaccagcugcgggaggauuggcagcucgucgacgugaugaaagaacugaaucuucccaaguacgaggcccugggguuuguggagacguaugaagauaaagacggccgcaagaucaaaagaauuaaggauuggaccaagcggaacgaccauagacaccacgcuauggaugcccucacagucgcuuucaccaaagacgccuuuauccaauacuucaauaacaagaaugccgcucaggauucuggaaaccgcaaccauacaaauauuaucggcaucaaaacccgguauuuugacaaggggagagcgcugcccccuauuccgcuggagcaguuccgcaucgaagccaaacagcaccuugagaagcugcucguguccauuaaggcuaaaaacaagguugugacggucaaugugaaccggaccaaaaagagaaaaggagaaaauacaaagauccaacagacaccccgcggccagcugcaucucgagaccguuuacgggagccacaaacaguaugugaccaagauugagaaggucaacgccucuuuugacgccgcuaaaaucgccacaguguccaagcgggcguacagaaaugcucugcuuaaacgccuggaaacguucggaaacgauccuaagaaagccuuuaccggcaagaaugcccucgagaagaacccccuguaugcugacaaauaccaaacaauccggguuccugaaaaggugcagaccgucgaguucgagacaauuuacaccaucagaaaacccguggauccggcccugaauguggacaaggucguugaugugaaagugcgggcgauucuugaacgcagacugaaggaguaugggggcgacccuaagaaggcuuuugucaacuucugggaaaaucccaucuggcucaacaaggagaaaggaauuagcaucaagcgggugucuauccgcggcauuaauaacgcccagagcauccauguuaaaaaggauaagaacgggaauccuauuugggacgaaaacggaaaacaaauccccguggauuucgucaauacgggcaacaaucaccacguggccauuuacagaaagccuguucuggacaaaaagggacaggugacauuugaugaggacggaaaccucauguaugagcuggacgaagucgugguucccuucuuugaggcugugacccgggccaaucuuggccugccgaucauugauaaagacuacagaaaguccgaaggguggcaguuccuguuuagcaugaaacagaacgaguauuucgucuuuccuaaugaaaagaccggcuucaaccccaaggagguggaucuccugaaucccgacaacuacgcuaugaucucuccuaaucuuuuucgcgugcaaacaauguccaaagucauguauggaaacaauguugugcgggauuacaaguucagacaucaccuggagaccacagugaaagacaugaaggaacucaaagauaucgccuacaagcaguauaagacgcugagcuuuggcaacuccgucgugaaaauucgcaucaaucauauugggcagaucguuucugugggagaguacuga

SEQ ID NO: 4492 - RNA, 4278 nt, Artificial Sequence
  Cas9 variant
augagacggaacauccugggccucgaccuggggaccacaagcauuggauucgccaaggugaucgaggaugaagacuaccaaaauuccgcugucgagcuuauuggcguucgcgugaacccccugacgaccgaugaacagacaaauuuugagaaagggagaccugugucugucaacgccgaccggacccucaagcgcggaaugagacggaaucuggaucgcuaucagcuuagacggcaccaucugaucgaagugcucaaagcgaaccacauuaucacaguugacaccaagcuggcugaggauggcaaaaauacaacccaugccacguacgccgugcgcgcucuggccgcuaccgccgagaucccgcucgaagcguucgccagaguccugcuugcuauuaacaagaagcggggguauaaaagcucccgcaaggccaaaaaugaggacgaaggacagcugaucgauggcauggcuguggccaagagacucuacgaggagaaccugacacccggccagcuuucuuaucugcuccugaaagaagggaagaaguaccugccugacuuuuaucggagcgaucucaaugcggagcuggacaaaguuugguccuuccaaaagcaguuuuaccccgaaauucuuaccgaggaguucaaaaagcaccuggaaggaaaaggccagcgcgccacaucugcugccuuuugggggcaguacggauucaacaccgcugagaauaagggcagcagagaagagaaaaagcucaaggccuaucaauggcgguccgaagccguggaucagcagcugacgaaagaggaagucgcuuacgugaucacagagauuaacaaugaccuuaacaagagcucuggguaucugggagcgaucuccgacagaagcaaagagcucuuuuucaacaagcagaccgugggccaauaccuguaucagcagcugaaacaaaauccucauacacgccucaagggccaggucuuuuaccggcaggauuaucuggacgaguucgaaaccauuugggaaacccaggccaaguuucaccccgagcuuacagcugcccugaaagaagagaucagagauguuaucauuuucuaccaacgcaagcucaaaucucagaaggggcugaucuccuucugcgaguuugaaagcaaagagauugaaguggagaagaacggacuuaagaucaaaaagcggauuggccugagaguggccccuaaaucuuccccgcuguuccaggaguuuaagaucuggcagguccucaauaaccuggaguuccgcaauaaaagcuccaaggaaguguuuguucccgacaugacggcuaagcaacaacucuucgaugaacugaacaucaaagggaaucuucuggccucugaggcgauuaagauccucggauacaaaaccaaggacugggaagcuaacuaucacacacuggagggcaaucggaccaacaaaagccuguacgaugccuaucuuaagauucucgagcuggaaggguacgacgaggaucugcucaaacuguccggaagcgacgauaucgacgugucuaagauugaaaaguccgccagcgagaucaaacagaugguccaugcuguguuugaaguucuuggcaucaauucuacaauucuggacuucgaugccgaggcugacggcaaggccuuugagcagcagaccgcguauagacucuggcaucugcuguacagcgccgaagaugacaacaaaaaguaucuucaggaggauaucuucauuuacgggcacgacaauaucggacucaaaaagaagcugugugaacgcuuuggcuuccggccugagcacacgaaaauucuggugaacgucgcuuuuuccggggauuacggaucucucagcuccaaggccaugagaaaaaucuaucccuucauuaaggaacugacauacgacaaggcuugccgcgaggccggcuaucggcacagcgcgucuucccuuagcaaagaggaaaucgccaccagaccucugcagaagcggcucgggcugcugaaaaagaaugagcuucgcucucccguggucgagaaaauccucaaccagauggugaacguugugaaugcucugauugaugacgaaaacaagagacggaaagccagaggccuguccgaugacuuccauuuugaugagauccgcauugaacucgcucgggagcugaagaagaaugccaaagaaagagccgagaugaccacaaacaucaaugcugcgaagcaacuucacgaaaagauuaucaaaauccugcagacccaguucggagucagcaacccgucccgcaaugacauuaucagauacaaacucuaugaggagcugaagaacaauggcuacaaagaccuguauacaaacacguacauuucuccugauauccuuuuuagcaagcaaauugacaucgaucauaucauuccccagaugucccucuucgacgauucuuuuagcaauaagaccgugguuuuccggaaagacaaccaggauaaggggaauaaaacagccuacgacuauauccugggaaaguacggcgaacuggcucucgaggaauauauuucccgcaucaccagccuguuugagcuugggaaaaagaacaaggaagagggaauuaauaaagccaaguuccagaaacugcaaaagagacucaucgauaucggcgacggguuuauugagaaagaucugcgggaaucucaguacaucgccaagaaggcuaaaaacaugcuguaugccauuugucgcuccguggucgcgacaagcggcgagaucaccgcuagacuucgggaagacugggaucuggugaacgugaugcaggagauuaaucucccuaaguuccgcgcccugggacucacggaaaugguugagaaaaaggacggcgggcagaaagagagaaucauugacuggaccaagcggaacgaucaccgccaucacgccauggacgcucugacaaucgccuuuaccagacacucucauauccaauaccuuaaucaccugaacgcgcggaaggaugaggcuuccaaauggcaucccgucgugagcaagauugaagaaaaagagacagaccucguguaugaugaccugggaaauagaaagcgccgguucaaagcccccaugccuaacuuuagagaggucgugaaggaacaccuggagaauguucuuaucucucacaaggccaaaaacaagguggucaccaaaaauaagaacaaaauuaagacggcuaaaggcgaaaagaucaagacagagcugaccccgcgcgggcagcuccauaaagaaacaauuuacggacgguacagauauuacgagagcaaggaggaaaaagugggccccaaguucgaugccgagaccaucgggaugguugugaauccucaguaucgcaaacugcuccuggaacggcuuaccacaaacggcaaugaccccaagaaggcuuucggaggcaaaaacacgcuguccaagaauccucucuacaucgaugaggccaaacaggaacugcugcccgagaagauucuucugagauggcucaacgacgauuauagcauccgcaaagacgucaccccggagaaccugaaggacgugaagacaauugaaaaaguucucgaugaggggaucaagaaaauucugcuuaagcggcugguggacuuuggaaaugauccuaaaaaggcguucucugaccuggauaagaaccccaucuggcucaaugaagccaaaggcaucaccauuaagagagucacaaucuccggggugaaaaacgcugaggcccugcacuacaagaaagaccauuuuggaaaugcuauucuuaacgaaaauggcaagcugaucccuagcuccuucgugucuaccgggaacaaucaccaugucgccauuuaucgggaugccgagggcaaccuccaagagcgcguugugagccuguuugacgcugugcagcucgucaaugcgggagaagccgugaucgauagagaguacaacaaaggcauuggguggcaguuccuguuuacgaugaagcaaaaugaaauguucguuuuucccaacgagaagacaggauucgacccuaaagagaucgaucuucugaauaccgacaaccggaagcugaucucccccaaucucuuucgcgugcagaaaauugcuucuaagaacuacuucuucagacaccaccuggaaaccaacgucgaggaacggaaagagcuuaaggauaucguguauaagccgcagcugggccucaaugccauuaaagacguugugaaggucagaaucaaccaucuggggaaaauuaucagcgugggagaauacuga

SEQ ID NO: 4493 - RNA, 4281 nt, Artificial Sequence
  Cas9 variant
augcccagaaagaacauccugggccucgaccuggggaccacaagcauuggauucgccaaaaucauugaggaugacgauuaccagugcuccucuguggaacuuaucggcguccggguuaauccucugacgaccgacgagcaaacaaacuuugaaaaggggaaaccggugagcgugaaugcugaucgcacccucaagagaggaaugcggcgcaaccuggacagauaucagcuucggcgcgauuaccugauugagauccucagaacacaccauaucauuaccgccgacacaaaacuggcggaagauggcaagaauaccacgcacaccacauaugcucugcgggcccucgccgcuaccgccgagaucccccuggaggcuuucguccgcgugcuucuggccauuaacaagaaaagaggguacaaguccucucggaaagcgaagaaugaagacgagggacagcucaucgauggcauggccauugcucgcagacuguaugaagagagccuuacaccuggccaguuuuccuaccaacugcucaaagaggggaagaaguaucugcccgacuucuaccggucugaucugaacaccgaacucaauaaaguuuggaacuuucagaagcaguucuacccugagauccugacggacgaauuuaaacgccaucuugagggaaagggccagagagccacagcuguggccuucugggggcaacacggauuuagcauggcggaaaauaaaggcucccgggaggagaagaaacugcaugccuauaaguggagaagcgaagcugcccacaagcagcucaccaaagaggaagucgcuuucgugauuacagagaucaacaaugaccugaacaagucuuccggguaccuuggagccaucagcgaucgcucuaaagaacuguuuuucaauaagcagaccguuggccaguaucuccaccaacagcugaaagagaacccccauacccggcugaagggccagguguuuuacagacaagacuaucucgaugaguucgaaacaauuugggagaugcaggccaaguucuacuccgcucugacgcuugaacugaaagaggaaguccgcgacguggugaucuuuuaucagcggaagcucaaaagccagauggggcugauuucucuuugugaguucgaguccaaggaaaucgagauugagaaaaacggagaaaaggcgaagaaaagaaucggccugcgcgucgccccuaagagcuccccgcucuuucaagaguucaaaaucuggcagguucugaauaaccuggaauuucggaauaagaaaaccaaggagguguucgugcccgaaauggcugccaagcagcagcucuuugaugagcugaacauuaaagggaaucuucuggccucugaagcuaucaagauucucggauacaaaacaaaggacugggaggccaacuaccacacccuggagggcaauagaacaaacaaaagccuguaugaugcguggcuuaagauccucgaacuggagggguacgacgaaaaucugcucaaacuguccggaagcgaugacauugaugucucuaagaucgagaagccugcucuugaaauccgccaaauggugcuggccguuuucgaggugcucggcauuuccggcgccauccuggacuuugacgcugaggccgaugggaaggcuuucgaacagcagcccgccuaucagcuguggcaucuucucuacagcgcggaggacgauggaaagaaauauucucaagaagacauuuuuaccuacggccacgauaacaucgggcugaagaaaaagcugugcgagaaguucggauuucggccugaacacacgaaaauucucgucaaugugguuuucagcgacgauuauggcaaccuguccucuaaggccaugagacgcaucuaccccuucauuaaagagcuuacauacgacaaggcuugugccgaggcuggguaucggcauagcgccgcgucccugaccaaagaagagaucgccgcuagaccgcuccagaaucggcuggaucugcuuaagaagaacgaacuccgcagcccuguggucgagaaaauccugaaucagauggugaacgucgugaacacccugguugacgaugagaaucagaacagaaaggcccggggccucucugaagacuuucacuucgaugagauuagaaucgaacuggcucgcgagcuuaaaaagaaugccaaagaacgggccgagaugacaaccaacauuaauacagcuaagcaaucccaugagaagaucauuagaauccugcagacggaauuuggagugcccaacccuagccgcaaugacaucgucagauacaaacucuaugaggaacugaagaacaauggcuacaaagaccuguauaccaacacauacauuucucgggauauccuuuucuccaagcagauugacguggaucacaucauuccccaaaugagccucuuugacgauuccuucucuaauaaaaccguuguguuucgcaaggacaaccaggauaaagggaauaagacagcguaugacuacauccugggaaaguacggcgagcaggcccuggaagaguauaucagcagaauuaccucccucuucgagcuggggaaaaagaacaaagaagagggaaucggcaaggcuaaauuucagaaacuucaaaagcggcuggucgauauuggggacggcuucaucgaacgcgaucucagagagucucaguacauugccaaaaaggccaauaacaugcuguaugcuaucugccggagcgugguguccacgagcggagaaaucaccgcccgccugagagaggacugggaucuuguuaacgucaugcaggagauuaaucugcccaaauuucgggcgcucggccugacagaaaugguggagaagaaagacggggcucagaaggaacgcaucaccgacuggacaaagagaaacgaucaucggcaccacgccauggacgcccucgcuauugccuucaccagacauucucacauccaauaccugaaucaucuuaacgcgcgcaaagaugaggcuaauaaguggcacccuguggucuccaaaauugaggaaaaggagacggugcugaucuaugacgaucucggaaaccggaaaagaaaguuuaaggccccgaugcccaauuuccgcgaaguugugaaagagcaccuggaaaacguccugauuagccauaaggccaaaaauaaggugguuaccaaaaacaagaauaagaucaaaacagugcggggcgagaaggucaaaacagagcuuaccccuagagggcagcugcacaaggaaaccaucuacggacgcuaucgguacuacgagucuaaagaagagaagauuggccccaaauucgacgcugaaaugaucgggauggugacaaacccucaguauaagaagcuccugcucgagagacuggccgcuaauggcaacgaucccaaaaaggccuuuuggggcaaaaaugcgcuuaacaagaacccgcuguacguugacgaggcccgccaggaacuccugccugagaaaauucugcuucgguggcugaaugaugacuauuccaucagaaaggaugugacgcccgaaaaccucaaggacauuaaaaccaucgagaagauccuggacaaaggagucaagaaaauucuccugaagcggcuugcugauuucgggaaugacccuaagaaagccuuuagcgaucuggacaagaaccccaucuggcaaaaugaagcuaaacgcauugccaucaagagagugacaauuucuggaaucaaaaacgccgcuccucugcaucacaagaaggaucaucucggcaaugacauccuggaugagaaagggaagcagauucccagcuccuucgugagcaccggaaacaaucaccacgucgcgaucuaccgggacgccgagggcaaccuucaggaacgcguugugucucuguuugaugcugugcaacucgucaaugggggcgagccggugauugacaaagaauauaacaagggaaucggcuggcaguuccuguuuacaaugaaacagaaugagauguucguuuuuccugaugagaagaccggguucaaccccagagaaguggaccuccuguccagcggaaaucggaaacuuauuucccccaaccuguuuagaguccagaagcuggccucuaagaauuacuucuuccgccaucaccucgagacgagcguggaagagaaaaaggaacugaaaaacaucgccuauaagccucaacuuggccugaacgcucucuccaauauuguuaaagugcggaucaaccauaucggggagauugucucugugggagaguacuga

SEQ ID NO: 4494 - RNA, 4281 nt, Artificial Sequence
  Cas9 variant
augaagaacauccugggccucgaccuggggauuaccagcaucuccuucgcccacauuguggaggaugaaaauaaagagaagucugaaaucaaagagcuuggagucagaauuguuagccugacaacggacgaacaguccgauuuugagaagggcaaaucuaucaccacaaacgcuaaucggacccucaagcauggggcccgccugaaccuugacagauaccaacagcggcgcaaguaucugaucgaucuccugcagaaagcgaaucugauuacaagcuccucuauccucgcugagaacggaaagaauaccacacacagcaccuggcagcugagagccaaagccgugacggaacggauugagaaggaagaguucgcucgcgugcuucuggccaucaacaaaaagagaggcuacaaguccagccggaaagcuaagaccgaggacgaagggcaagccauugauggaauggcgaucgccaaacgccucuaugacgagaaucugacacccggccagcuuucucugcagcuccugcagcaaaacaagaaacugcucccugauuuuuacagauccgaccugcagcgggaguucgaucuugucuggaauuuucagaagcaguucuauccggacauucugaccgauagcuuuuacaaagaacuccaaggcaaggggaaggacgcuacaucuaaagccuucuccaagcgcuaucauuuugacaccgcugaaaacaaaggaagcaaggagucugugagacugcaggccuaccaguggcgggcggaggccaucuccaaacaacuuagcaaggaagagguugcuuacgugcugacggaaaucaauaacaaucucaacaacgccuccggcuaucugggggcuauuucugaucgcagcaaggagcuguacuucaauagacagacagucggacaguaucucuacgcccagcugcaagaaaaccggcacaauucccuuaaaaacaagguguuuuauagacaggacuaccuggaugaguucgagcgcaucugggaaacccaggccagcuuucauaaagagcucacagacgaacugaagaaacagauucgggauguugugaucuucuaucaaagaaaacuuaagucucagaaaggccugauuuccuucugcgaguuugaaagcaaggagaucgagaucgaaaaagacgggaagaccauuaccaaaacaaucggagcucgcgucgugcccaagucuagcccucucuuccaggaguuuaagauuuggcagauccugaauaacgugacguguaaacggaagggcauuagaaagaagaaauccucugcuaagagcaccgaacuggaucucuucaaugagcccucccaaacaaucuuuagccuggacauggagugcaaacagcuucuguucgaugaacucaaccugaagggcgaccugaagucugauaaaguccuuaagcuccugggguacuccccucaggagugggaaaucaauuacaaccagcuggagggaaaucgcacccaaaaagcccucuaugaagcguaccugaagauuguugagauggaggcccacgacgugaaagacauccuucagauuaagagcgccaaggaugacuggucucuggaugaaagcccccucuccgcuuccgagaucaaagaaaaggugaaagacauuuuucaggcccugggcaucuguacaaagauucuguauuucgauccucuucucccggucaaagaguuugaaaagcaagacucuuaccagcuguggcaucugcucuauagcuacgaguccgaugacucuaccagcgggaacgagacgcuguaucggauccuugaaaagaaauacgcguucaagagagagcacgcucgcauccuggccaauguggcccuccaggaugacuacggaucccugagcacaaaagcuauucggaagaucuaucccaacauuaaagaaaaucaguacucuaaggccugcgagcuggcuggcuauaagcacuccaaacuuagccucaccaccgaggaacuggaggccagagaacugaagaacaucauuccucuccugaaaaagaacgcgcuucgcaaucccguuguggagaaaauccugaaccaaaugaucaaugucgugaacgcccucauugaaaagaacucugagcgggaugcugaggggaaaaucacaaaguacuuucauuucgacgaaauuagaaucgagcuggcccgggaacugaagaaaaaugcucagaagcgcuaugagaugacccagaauauuaacaaagccaaacuugaacaccagaaaaucuccgagauccuccaaaagaaguuuggaauuaaaaauccuacaaagagcgauaucauuagauaccggcuguaucaggagcuggaacacaacggcuacaaagagcucuacacgaaugcgcccaucgccagagacaugcuguucucuaagaacauugaaaucgagcauaucguuccgaaagcucgcguguucgacgauagcuuuuccaauaagacccuuacauuccaccggauuaacagcaauaagggcgaauauaccgccuuugacuacaucacaucucugaacuccgaggaggaacucaaccaguaucugaccagagucgagaaugcuuacaaaaccaagagcauuucccugacgaaauauaagaaccuucugaaaaaggccucugaaaucggggauggauucauuaaucgcgaccucagagauacacaguacaucgccaagaaagcuaaggagauucuguuucaagugaccaaaaacguccucagcacauccggcucuaucaccgaccggcugcgcgaagauugggggcuuguggacguuaugaaggagcugaauaugccuaaauaucagagccucggacugacggagguggaagagagaaaggaaggcaacaaggucacagugaucaaaaauuggaccaagcggaacgaucaucgccaccaugcgauggacgcccugacaguugcuuucaccaaacccuccuacauucaguaccuuaaucaccugaacgccagaaaggaugagaauaacaaaaauuauucugugauccucgccauugaggaaaaggagaccaucaaagucccuacaaacaaugggaagaacaagcggguguuuauugaacccauccccaacuuccgccaaguggcuaaaaagcaccuggaggaaaucuuuauuagccauaaagccaagaauaaaguugucacgaagaacgugaauaagccugcgggcaccgacaaacagcagaucacacucaccccgagaggacagcugcacaaggagacaauuuacggcaaauaucaauacuaugugaacaaggaggaaaaagucggggugaaguucgaugagcggaccaucacgaagguuuccaauccccuuuaccgcgaagcucugcucaaaagacugcaggccaacgacaaugacccuaagaaagccuuuacaggaaagaacgcucugagcaaaaaucccauuuaucuugaugagaccaagaccaagacacugccugaaaaagugaaccucaccuaccuggaggaggacuucucuauccggaaggauaucucccccgacaauuuuaaagaucucaagagcauugaaaaagucaucgaccagggcgugaagcgcauucugaucaaaagacuucaggauuacgacaacgauccgaagaaggccuucguugaccuggagaaaaauccuauuuggcugaacaaggaaaaagggaucgcgauuaagcgggugacaaucucuggagucuccaaugcucaaccccuccauaucggcaaagaucaccuggggaagacgacccuuaacaaggagggcaaugaaauuccuguggacuauguuagcacaggaaacaaccaccauguggccaucuacagagacaaagagggcaaucugcaggagcagauugucucuuucuuugaagccguggugcgcacccagcaagggcuccccaucauugauaagacauauaaacaggaggaaggauggcaguuccuguuuaccaugaagcagaacgagauguucgucuuuccuaaugcuacgaccggcuucaaccccgccgagaucgaccuccuggauccgaaaaauaagaaacuuaucuccccuaaccuguuucggguucaaaagauugcuacaaaggacuacuucuuuagacaccaucuggaaaccaauguggagacagauaacgugcucaagaauaccacauggaagcgcgaagggcugagcggacuuaaagacaucgucaaggugcggauuaaccaccugggcgauaucguuuccauuggggaguauuga

SEQ ID NO: 4495 - RNA, 4281 nt, Artificial Sequence
  Cas9 variant
augaagcacauccugggccucgaccuggggaccaacagcauuggaugggcccuuaucaaacaggauuucgagaauaagcaaggcgaaauucuggggaugggauccagaaucauucccaugucucaggacauccucggcgauuuugggaaaggaaacagcgugucccagacagcugagcggacgaaguaccgcucugucagacggcugcgcgaaagauuccuucugcggcgcgagagacuccaucggauccugaauguucugggcuuucucccugaacacuaugccagccagauugacuucaccaaacgcuuuggcaaguucaaggaggagacagaaccgaaacugguguacuccaacgagggguuuaucuucaagaaaucuuuugaagagaugcuuagcgauuucaagacccaucaaccccagcugcucgaggacaauaaaaagauuccuuaugauuggacaaucuacuaucugagaaagaaagcgcuuucccggaagauugaaaaagaggaacuggcuuggauccuccugaacuuuaaucagaagcgcggauacuaucagcugagaggcgaggaagaggaggaaaaccccaauaaacucauugaguucuacagccugaagaucguggacguccuugccgaugaaccucaaaaagggaagucugacaucugguacucccugauucucgagaacggauggaucuaucggcgcagcucuaagacaccccuguuugauuggaaagaaaagaccagagacuucauugugaccaucgaucuuaaugacgacggcuccguuaaaacggauaaggaggggaacgagaaacggagcuucagagccccuggagaaaaugacuggacccuggugaagaagaaaacagagcaggaaauugauucuucccgcaagaccgucggcacauacaucuaugagacccuccugaaaaacccgaagcagaaaaucaagggcaagcuggugcggacgauugaaagaaaauuuuacaagacagagcucaaacagauccuggagaagcaaaaagaguuccaccccgaacuucgccaggacgaucuguauagcgacugcguucgggaacucuacaagaauaacgaggcucaucagcugacccuuuccaagaaagauuuugugcaccuguucauggaggacauuaucuuuuaucaaagaccucucgggucucaaaagagcuccauuagcaacuguacacuggaguuccgcaaauacaaggaugaaaauggaaccgaacacacccaguaccugaaagccauccccaagucuaacccuuauuaccaggaguuucggaucuggcaauggauguauaaucucaacauuuacaaaaaggaagacgauacaaaugucacgaaggacuuccugaacaccaaagcugacuuugagucccuuuucgaguuucugaauaacagaaaggaaguggaucagaaagcccuccugaagcauuucaaacugaaugacaagacacaccgcuggaacuauguggaggauaagaaauaccccugcaaugaaaccaagacaaugauccuuagccggcucgacaaagucgagaacauuucugaugacuuucugaccagagaaauggagcagaagaucuggcauauuaucuauagcguuaaugauaaaguggaguacgaaaaggcgcugaaguccuucgccggcaaaaacaaucucgaggacaacucuuucuuugaggcuuucaagaaauuuccgccuuucaagagcgaauacggggccuuuuccgaaaaagcuauuaagaagcugcuuccccugaugcgcaugggaaaauucuggaacuauaauaacaucagcgagcagucuaagucccggauccagaaaauuaucacgggcgaguacgaugaaaauauuaaggacaaagugagagagaaggccauccaccucacaaccgaaaccgauuuucaggggcugcagcuguggcuuguccaguauauuguguacggacggcacagcgaggcggccaugcucggcaaauggaacucugcugacgaucuggaggaguuccugaaggaauuuaagcaacauucccuccgcaauccuaucguugaacaggugaucacagagacccugagagucgugaaagacauuuggcagaaguauggcaacggggccaaagacuucuuucgggaaauccacauugagcuuggaagagagaugaagcugcccgcugaggaacgcgaacggcucacaagacagaucagcgagaaugaaaacacgaauuuccgcauuaaagcccugcuggccgagaugauggaugacaacuccguugagaaugugagacccuuuucuccuaugcaacaggaaauccuuaagaucuacgaggaaggcguccucaacagcgauauugagaucgaagacgauauucugaagaucuccaaaaccgcucagccgucuagcuccgaccugaagcgguauaaacucuggcuggagcaaaaguacaaaagccccuacacagggcagauuaucccucuuaauaagcuguucacccccgaguaugaaaucgagcauauuaucccucagucucgcuacuucgaugacuccuuuacaaacaagauuaucugugaaagcgcggugaauaaacucaaggauaacuauauuggacuggaguucaucaaaaagcugggcgggucuauugucgagugcggcaacggaaaauccguggccauccuuaagcacgacgcuuacgaagauuuuaucaagaaacauuaugccaauaacagaagcaagcggaauaaacuccugcuggaggacauucccgaaaagaugaucgagcgccagaugaacgauaccagauacauuucuaaauauaucagcggcguucucuccaauauugugcgggucgaagacgggacggacgagggagugaacagcaagaauaucguuccgggcaacgggaagaucaccacacaacugaaacaggauuggggacuuaaugacguguggaacgaucugauucucccucgcuucgagagaaugaaucaccugaccaacucuacagacuuuaccgccuggaaugaaaaccaccagaaguuccugcccacggucccuguggaguuuuccaaaggcuucagcaagaaacggaucgaucaucgccaccaugcucuugacgcccuggugauugcgugugcuacaaaggaucacguuaaucuccugaacaaccaguccgccaaaucugacaccaagagauacgaucucaagaaaaagcugaugaaauuugaaaaggucgccuacaaucacccccaaacaggggagcggaucgaaagagaggcuccuaaacaguuccuuaagcccugggagaccuuuaccauugacgccaagaaccaucuggaaacaaucaucgugagcuucaaacagaaucuccgcgugauuaacaaggcuacgaauuauuacgagaaauaugucgaaaaggagggcaccaaagugaaggaacggguugagcagaagggaacaaacugggccaucagaaaaccgaugcacaaggagaccguguccggcaaaauugaucugccucgcaucaagguccccaaagggaagauucugacagcgacccggaagucucuugacacgagcuucaaucugaaaacaaucggauccauuaccgacaccggcauccaaaagauccucaaaaacuaccugcaguauaaggauaauaaccccgaacucgccuuuucuccugaggggauugaagacaugaauaaaaacaucgagaaguucaauaacggaaaagcucaucagagcauuuccaaggugagaguuuuugagcugggcagcaaguucccgcuugggcaaucuggcaauaaaaaggaaaaauacguggaggccgcuaagggaacaaaccuguuuuucgccaucuaucaggauaaaaauggcaagcgcuccuacgaaaccauuccccucaacgaggucaucgaacggcagaagcaggggcugagcgugguugaccugaaaggaguggaugacuuuuaccuuucuccuaacgaucuggucuaugugcccuccgaggacgagcucgaaaauaucagcaugauugauuucaacaagaugucuuccgagagaaucuacaaaguggucagcuuuacaggcaaucaaauuuucuuuguucgccaggacaucgcgacguccguggugaacaaggccgaguucagcacccugaauaaaauggaacgggcuauugaugggacaaugaucaaggaaaccugcgucaagcuccagaucgacagacugggaaacauuucuaaaaucuga

SEQ ID NO: 4496 - RNA, 4281 nt, Artificial Sequence
  Cas9 variant
auguacaacaucggccuggacauugggaccggaagcgugggcuggugccucacagaugagaauggguaucugcuuaaggucaacagaaaaggaaauaacggcaauacguaccggaacuccgccuggggaguucgccuguucgaaucugcugacaccgccgcggauuguagaaucaagcggagcacacgcagacgguauaaacgcagacggacccgcauuaucgagcucagaaagauuauguccgacaugaucaugcccaucgauccuaauuuuuacgcucggcuggacgaagccuuccuuuggaacgaggauaaaucugacaaggccaaggcuccguuucuccuguucaaugauaacggguaugacgaugugaaauacuauacagacuaccccaccauuuaccaccuccgcaagcaucugcuggaaacaaaagagaaggccgauccuagauuuaucuaucuggcccuucaccauaugaugaaauaccggggccacuuccuguuugagggccagagcuucgaagcuauugacaauaucgaggacaccuuuauugaacucgagcaucuggugaacgucuaugugaaggagaaggaagauacggacaauaacgcggagaauaacgcccuuuaccaagaaaugaaaaacuaucuggcugauaauaagguuaaaaacaaggacaaaaaggaguacaucaccgauacauucauuaaagccgacuaugauaauaaguacuccaaggaacucgcugccgcggugcugggguacgaguuuaacgucggaaucaucgugaaugacaacucucugaccgaugaggacggcaaagcccucaaggcuaaauucgccgaugcuaaguaugaagagaaagaagagaagcugagcgacacacuuggggaacgcuacuauauuaucgagacccugaagaaaauuuacuccuggaagguucuccacagcauccugggagacaauaaauaucuuucuuacgccaugguggauaaguaugagaaacacuccgaacagcugaaggcccucaaguaccuguuucauaaauacacgagccaggacgaguauucugaguucuuccaccaggaaaagaacaaagaaggcaaguacauugucaauuaugcuaacuacaucaaagggaucaagagacuguccaaugagacaaacaagaaauauaauaccaagcaacagcucuaccagagcauuaugaaaauccugggagagcgggcggccgaugacgaaguguauaagaaaauucuuguggagauggaacaggagacauuucuggagaagaucaacaaugucgauaacucugcuauucccuaccaacucaaccugauggaaauggacaaaauccuuacccagcagggcguuuacuauaaggagcugagagauaauaaggaacuccugcugaaaaugcucaccuccaagaucccuuacuaugugggcccccugaacaauaacagcaaugggaaccgcaauuucgccuggaugacgaaaaaggacggaaaagagaacgaaaagguguacccuuggaaugucaaggaugugguugacauugaugugacagccgaggacuuuaucacccggaugacaaacuauugcaccuaccuuccgaaugagaaaguccugcccaaggaaucccuccuguaucagagauacaugcugcuugaggaacucucucaaauucgcaucgauggccggaaacugagcaaggaggacagaaaagcuauuaucaacgaccuguucauugggaagggacgcgugaagguuuccgauaaagacuuuaaggaauaccucaauaaagugaacuaugucaaggugaauggcaaaggguacgaugucacaggauaucagagcgacgauggcuucgccugugcgcugucuuccuacaacaaguuucggagaauccuuggccauaucgacgagcagaacgagaagaugauugaagauaucauuuauuggaucaccguguucgaggacaaagauauuguuaagcgcaaaaucaauaagcaauacgcugaccggcugagcgccgaacagcucaaaaagauccugaaacugaaguuuaagggguggggaagauauucuagcaaacuucucaacggcauuaagggggauaugggaacgacaaucauugagaugcuggaagacgccgaugagcgcuucgcuuacugcgacuacuguccuaauuuuaugcagaucauuaacaaagacgagaagaucaaacagaucauugaugacaaucggcccagauaugauggcaccaaggaccugcucgaugugauccaagacaugcacaccuccccugccaaccggcgcgggauuuggcagacaaugaaggcuaucgaagagauuaucgaauacaugggcgagaaaccccagcagaucuauauugaguucgccagagaagaugacccgaaggcgaaaaauaagcgggccgauucuagaaaacgcgcuaucgacaaggcccugaagaaacuuaaggaggaugucguggacgaauacaacgagaaaguuuauaaggaacugaaacaauacgagaagcggcucgacgaggaaaagguguaucuguacuuuaugcagaauggaaaagaucuguacuucccugacaaggagcuuaaccucgaugaacuggagaaacuggaaauugaccacaucauucccuauagccucuccgaugacgauagccuggacaauaaggcucuuguccugaaaggcaacaaucagaacaaggggaauaagaucgugaaagaggccuucccucagcucuuuucuaacuccggaaccgugaacuacuggaagaaucugaaaaaggcgggccugauuagcgagaaaaaguauaacaaucuucagaaaaacaauguugaugacauccucacaaagggguucaucaacagacaacuggucgaaacgcgccagauugugaagucuguggccaaucugauccucgauuacuauaacgagcagauugacgucaucgaagugaaggcuucccugagcaccuccguuagaaaaaugcuuacauacgagaaaaaggauaauaacggauuuuggauugaaaauaaagacaacugcauguucuauaagaaucgggacaugaacgauuaccaucacgcccaugacgcuuaccuggccaauaucaucggccucuauauucaaaagaacuacccccgccugcagaaagagcugaauuauucucaguacagacggaucuggcgcaaguauuacgagaacaccaaaaacaauaacggggugaauugguuugccacacuuggcaaguucagcuccaacaaugaagaggcugauugguauggacaagacauuaucgcguacaugagaaaaaucuuuuguuaccgggauguccugauuucuaagaagguggaagagaacaccggcgccuucuauagcgagacgaaauacccccgcgaagacaaggcuggguccaaacucguuccucugaagcagggaaauaacaugagaggcgccaauaaccucaaagagcuggaugcccggaaguaugggggauacaagggcggggaaaaggcuuauuuugugcuugucaaauacugcaucgagaaagcccugaagaaaaaggugaaaaaggaauaucacauggaguucguugagauuccgguguacaucgcgcgcggcauuaagaauaaagacaucaaccucuacgauuaugucugugacauucugaaugaagcuaacaagaauagcguggccgauguggagauccugagaaacaaaguccccaaguaccagaugauuaucggagaaaacggcgaggaauauuaccuuguuucugccaccgaggugaucaauuccaaacaguuugugcucgggggagcuaaccaacaguauaaucggcugcugaacuacauuaaguauggcaagaaugacaaauggcaguacauccagacagagcuccuggaugaacaacuuauugggcuguacaaccuccugaucgccaagauuaaagacgaguauaagggauucagcaaagaagcggucagaauccaggagaauaacucuuuugacaagcuggaugugaaggacaaaaaggaguucaucgcugaaaugauuaaacuuguucagccugauuccgacuaccccuaucugggcaaguacgccaccgggcucagcaaucgcaugggccggaaaacaggagagaaggugggcaagaaaaucacccuggucgauaagucugugacggggcucuaugaaagacgcacaaccuucgagcuggaagacgauagcuccacaaaaagcugcuga

SEQ ID NO: 4497 - RNA, 4281 nt, Artificial Sequence
  Cas9 variant
augaagaacauccugggccucgaccuggggaccacaagcauuggauucgcccacaucguggaggaugaaaauaaagagaaguccgaaauuaaagagcuuggcgucagaaucguuucucugacgaccgacgaacaaagcgauuuugagaaggggaaauccauuacaaccaacgcuaaucggacacucaagcauggagcccgccugaaccuugacagauaccaacagcggcgcaaguaucugaucgaucuccugcagaaagcgaaucugaucacccccucuagcauucucgcugagaacggcaagaauacaacccacuccacguggcagcugagagccaaagccgugaccgaacggaucgagaaggaagaguucgcucgcauucuucuggccaucaacaaaaagagaggguacaagucuagccggaaagcuaagacagaggacgaaggacaagccauugauggcauggcgaucgccaaacgccucuaugacgagaaucugaccccuggccagcuuucccugcagcuccugcagcaaaacaagaaacugcucccggauuuuuacagaagcgaccugcagaaggaguucgaucuuguguggaauuuucagaaacaguucuaucccgacauucugacagauaucuuuuacaaggagcuccaagggaagggaaaagacgcuaccucuaaggccuucuccaaacgguaucauuuugacacgacagaaaacaagggcagcaaagagucuguccgccugcaggcuuaccaguggagagccgaggcgaucuccaagcaacuuagcaaggaagagguggccuacguucugaccgaaauuaauaacaaucucaacaacgcuucuggguaucugggagccaucuccgaucggagcaaagagcuguacuucaaucgccagacagugggccaguaucucuacgcuaagcugcaggaaaacagacacaauucccuuaaaaacaaggucuuuuaucggcaagacuaccuggaugaguucgagagaauuugggaaacccaggccucuuuucauaaagagcucaccgacgaacugaagaagcagauccgcgaugugguuauuuucuaucagcggaaaccuaagagccaaaaagggcuuaucuccuucugcgaguuugaaagcaaggagaucgagauugaaaaagacggaaagacaaucacgaagaauauuggcgccagagugguccccaaaucuuccccucuguuccaggaguuuaagaucuggcagauucucaacaaugugaucuguaaacgcaagggcauccggaaaaagaaaauuagcgcuaagaccacacagcuggaucugcucaacgaaucuagccaaaccaucuucucccuggacauggagugcaagcagcuucuguuugaugagcucaaucugaaaggggaccugaagucugauaaagugcuuaagcuccugggauacagcccccaggaaugggagauuaacuacaaucagcuggaaggcaacagaacacaaaaagcgcucuaugaggccuaccugaagaucgucgaaauggaggcucacgacguuaaggacauucuucagaucaaauccgccaaggaugacuggagccuggaugagucuccucucuccgccagcgaaauucgcgagaaagugaaggcuaucuuccagacccuggggaucuguacgaaaauucuguauuuugacccgcuucuccccgugaaggaguucgaggaacaagauucuuaccagcuguggcaucugcucuauuccuacgagagcgacgauuccacaucuggaaaugagacccuguaucggauccuugaaaagaaauacgccuuuaagagagagcacgcgcgcauucuggcuaacgucgcccuccaggacgauuacggcagccuguccaccaaagccauccggaagauuuauccuaauaucaaagaaaaccaguacucuacagcuugcgagaaggccggguauaagcacagcaaacugucccuuaccacagaagaacucgaggcuagagaacugaagaacaucauuccccugcucaaaaagaaugcccugcgcaacccugugguugagaaaauccuuaaucaaaugauuaacguggucaaugcgcugaucgaaaagaacagcgagcgggacgccgagggaaaaauuacgaaguacuuccauuuugaugaaaucagaaucgagcucgcucgggaacugaagaaaaaugcccagaagcgcuaugagaugacccagaacauuaauaaagcuaagcuggaacaccagaaaaucucugagauucuucaaaaggaguucggcaucaagaaccccacaaaauccgacauuaucagauaccggcucuaucaggaacuggagcacaauggcuacaaggaacuguacaccaacgccccgaucgcgagagauaugcucuuuagcaaaaauauugagaucgaacauauugugccuaaggcccgcguuuucgacgacucuuucuccaacaaaacacugaccuuucaccggaucaauagcgauaagggggaguauacggcuuucgacuacauuaccucucuuaacagcgaggaagaacugaaccaguaucucacaagaguggaaaaugccuacaagaccaaauccaucagccccacaaaguauaaaaaccugcugaagaaggcuucugagauuggagaugacuuuaucaaucgcgaucuuagagacacccaguacaucgccaaaaaggccaaagaaauucuguuccaagucacgaagaacgugcucuccacaagcggcuccaucaccgaucggcugcgcgaggacugggggcucgucgaugugaugaaagagcugaauaugccuaaguaucagucucuuggacugacagaaguugaggaaagaaaagacggcaacaaggugaccgucauuaagaauuggaccaaacggaacgaucaucgccaccaugcuauggacgcgcucacaguggccuuuacgaagcccagcuacauccaguaccugaaucaccugaacgcuagaaaagaugagaauaacaagaauuauuccguuauucuugccaucgaggaaaaagagaccaucaaggugcccacaaacaaugggaaaaacaagcgggucuucauugaaccuaucccgaacuuucgccaaguggccaagaaacaccuggaggaaauuuucaucucucauaaggcuaaaaauaaggugguuaccaaaaacacaaauaagcccgccggcaccgacaagcagcagauuacgcucacaccuagaggacagcugcacaaagagaccaucuacggcaaguaucaauacuauaucaacaaagaggaaaagauuggggucaaauuugacgagcggaccaucgcgaaggugagcaaucccguguaccgcgaagcucuccugaagagacuucaggccaacgauaaugacccuaaaaaggccuucgcuggcaaaaacgcccuguccaagaaucccauuuaucucgaugagucuaaaacaaagacccugccggaaaaggucaaccugacauaccuugaggaggacuuuagcauccggaaagauauuuccccugacaauuucaaggaucugaaaagcaucgaaaaggugauugaccagggaguuaaaagaauccucaucaagcgccugcaggcguacgauaacgaccccaaaaaggcuuuuguggaucucgagaagaauccuauuuggcugaacaaagaaaaggggaucgccauuaaacgggucacgaucucuggagugaauaacgcccaaccccuucauauuggcaaggaccaccuggggaaaaccacacugaauaaggagggcaaggaaaucccuguugacuauguguccaccggaaacaaccaccaugucgcuaucuacagagauaaagagggcaaucuccaggagcagauugugagcuucuucgacgccguugugcgcgcucagcaagggauccccauuaucgauaagacauauaaacaggccgaaggauggcaguuucuguucaccaugaagcagaacgagauguuugucuucccgaaugcgacgaccggcuuuaacccugccgaaauugaccuucuggaucccaaaaauaagaagcucaucucucccaaccuguuccgggugcagaaaaucgcuacaaaggacuacuuuuucagacaccaucucgagaccaauguggagacagauaacauucugaaaaaugucaccuggaagcgcgaagggcuuuccggacugaaagacaucguuaaggugcggauuaaccaccugggcgauaucgugagcauuggggaguauuga

SEQ ID NO: 4498 - RNA, 4281 nt, Artificial Sequence
  Cas9 variant
augaagaacauccugggccucgaccuggggaccacaagcauuggauucacgcacaucguggaggaugaaaauaaagagaaguccgaaauuaaagagcuuggcgucagaaucguuucucugaccacagacgaacagagcgauuuugagaaggggaaauccauuucuaccaacgccaaucggacacucaagcauggagcucgccugaaccuugacagauaccaacagcggcgcaaguuccugaucgaucuccugcagaaagccaaucugaucaccagcuccucuauucucgcggagaacggcaagaauacaacccacagcacguggcagcugagagcuaaagccgugaccgaacggaucgagaaggaagaguuugcccgcgugcuucuggcuauuaacaaaaagagaggguauaaguccagccggaaagccaagacagaggacgaaggacaagcuaucgauggcauggccauugcgaaacgccucuacgacgagaaucugacccccggccagcuuucucugcagcuccugcagcaaaacaagaaacugcucccugauuucuauagauccgaccugcagaaggaauuugaucuugucuggaauuuccagaaacaguuuuacccggacauccugacagauagcuucuauaaggagcuccaagggaagggaaaagacgccaccucuaaggcuuuuuccaaacgguaccauuucgacacggccgaaaacaagggcagccgcgagucugugagacugcaggcuuaucaguggcgggccgaggcgauuuccaaacaacuuagcaaggaagagguugccuacgugcugacagaaaucaauaacaaucucaacaacgcuuccggguaccugggagccaucucugaucgcagcaaggagcuguauuuuaauagacagaccgucggccaguaccucuaugcucagcugcaagaaaacaaacacaauucccuuaagaacaaaguguucuaccggcaggacuaucuggaugaguuugagagaauuugggaaacacaggccagcuuccauaaggagcucaccgaggaacugaaaaagcagauccgcgacguugugauuuucuaccaacggaaacuuaaaucucagaaggggcugaucuccuuuugcgaguucgaaagcaaagagauugaaaucgagaaggauggaaaaaccaucacaaagucuauuggcgccagagucgugcccaagagcuccccucucuuucaggaguucaaaaucuggcagauucugaauaacgugacguguaagcgcaaaggcauccggaagaaaaagucuagcgcuaaauccaccgaacuggaccucuuuaaugagcccagccaaacaauuuucucucuggauauggaaugcaagcagcuucuguuugaggaacucaaccugaagggggaccugaaauccgauaagguccuuaaacuccugggauauagcccucaggagugggaaaucaauuacaaccagcuggagggcaauagaacccaaaaggcgcucuacgaggccuaucugaaaaucguugaaauggaggcucacgacgugaaggauauucuucagaucaagucuacaaaagacgacugggcccuggaagagagcccccucuccgccuccgaaauucgcgagcgggugaaggcuaucuuccagacccuggggauuuguacgaaaauccuguacuuugauccucuucucccggucaaggaguucgaggaacaagacucuuaucagcuguggcaucugcucuacagcuaugaauccgaugacucuacaagcggaaacgagacccuguaccgcauucuugagaaaaaguaugccuuuaagagagaacacgcgaccauccuggcuaaugugacacuccaggaugacuacggcucccugagcaccaaagccauccggaagauuuaccccuauaucaaagagaaccaguacucuacagccugcgaaaaggcuggguauaaacacuccaagcugagccuuacgaccgaggaacucgaggccagagagcugaagaauauuaucccucugcucaaaaagaacgcucugcgcaaccccguuguggagaaaauucuuaaucaaaugaucaacgucgugaaugcccugaucgaaaagaacucugaacgggaugcggagggaaaaauuacaaaguacuuccauuuugacgaaaucagaauugagcucgcccgggagcugaaaaagaaugcucaggaacgcuaugagaugacccagaacaucaauaaggccaaacuggaacaccagaagauuuccggcauccuucaaaaagaguucggcaucaagaacccuacaaaaagcgauauuaccagauaccggcucuaucaggaacuggcucacaauggguacaacgaccuguacacgaauaccuauauccccaaggagcuccuguucucuaagaacauugauaucgagcauauuguuagcaaagccagaguguuugacgauuccuucagcaauaagacacuugcguuucgcgaguucaacaucaaaaagggagaaucuaccgccuuugacuacaucacaucccugaauaacgaagaggaacucaaccaguaucugaaucgggucgagaacgcuuacaaaaccaagaauauuagcccggccaaguauaaaaaccugcuuaagaaggcuuccgagaucggcgacggguucauuaauagagaucugcgcgacacgcaguacaucgccaagaaagccaaggaaauucucuuucaagugacaaagaacguccugucuaccagcggauccaucacagauagacuccgggaggacuggggccugguggauguuaugaaagaacuuaauaugccuaaguaucagucucuggggcucaccgagguggaggaacgcaaagagggcaacaaggucaccgugauuaaaaauuggacaaagagaaacgaccaccggcaucacgcuauggaugcgcugacgguugccuucaccaagcccagcuacauccaguaccugaaucaucuuaacgcucgcaaagacaagaauaacaaaaauuauuccgugauccuggccauugaagagaaggaaacaaucaaagucccuaccaacaacggaaagaauaaaagaguguuuauugagcccauccccaacuuccggcaaguggccaagaagcaccucgaggaaauuuuuaucucucacaaagcuaagaauaaaguugucacaaagaacaccaauaaaccugccggcacggauaagcagcagaucacacugaccccgcgcgggcagcuccauaaggagaccguguacggaaaauaucaauacuaugugaacaaggaagagaaaauuggcgucaaguucgacaaagaaacaaucgcgaaggugagcaaucccguuuacagagaggcucugcuuaagcggcugcaggccaacgauaaugacccuaaaaaggccuuugcugggaaaaacgcccucuccaagaaucccauuuaucuggaugaggcgaaaaccaagacacugacggaaaaggugaaccuuaccuaccuggaggaagacuucagcauccgcaaagacauuucuccugauaauuucaaggaccucaaauccaucgagaaggucaucgaucagggagugaaacggauucugaucaagagacuccaggacuacgauaacgaccccaaaaaggcuuuuguugaucuggaaaagaauccgauuuggcuuaacaaagagaagggcaucgccauuaaaagagugacaaucagcggggucaauaacgcccaaccucugcacauuggcaaggaccaucugggaaaaaccacacucaacaaggagggcaaggaaauccccguggauuauguuucuaccgggaauaaccaccacguggcuaucuaccgcgacaaagagggaaaucugcaggaacagauugucuccuucuuugaggccguggugggcgcucagcaagggcuuccuaucgucgauaagacguauaaacaggccgagggauggcaguuccuguuuaccaugaagcagaacgaaauguucguuuuucccaaugaggcgacaggcuucaacccugccgaaauugaccuccuggaccccaaaaauaagaagcaaaucagcccgaaccucuuucgggugcagaaaauugcuaccaaggauuacuucuuuagacaucaccuggagacaaauguggacaccgauaacguccuuaaaaauacaaccuggaagcgcgaagggcugucuggccugaaagacaucgugaagguucggaucaaccaucucggagauauuguguccaucggcgaguauuga

SEQ ID NO: 4499 - RNA, 4284 nt, Artificial Sequence
  Cas9 variant
augaagaaaauccugggccucgaccuggggaccagcuccauuggaugggcccuugugaacgaggcugaaacaucugaggaaaagagcuccaucauuaaacugggcgucagaguuaauccccucacgguggaugagcugcagaacuucgaaaaggggaaaucuaucaccacaaaugccgaccggaccgcgggacgcagcaugagacggaaccuucaacgcuacaagcugagacgggagaaucucauugaggugcugaaggaauauaacuuuaucacagaugagaugauccuguccgaaaauggcaaccgcaccacauucgagaccuacagacuccgggcuaaagccgccgucgaggaaauuucucuggagcaguuugcucgcgugcuucugaugaucaauaagaaaagaggguauaagagcucccggaaagccaagggagcugaaaacggcacgcucauugacggcauggagguugccaagaaaauguacgaugaagggaucaccccuggagagcugugccuucagcugcucacagcgggcaagcgcuauuucccggacuuuuacagaagcgaucugcaggccgaguucgaccggauuuggaauuuucaaaaacaguucuaucccgauucucugaucgacaaggugaaagaugaaguccgcgggaagaacaaaucccagaccugggcuauucucgccaaguacuuuguguggaaggagguugaaaauagcuggaacgaggaagaggcucagacaagacggguggagaaagaauacagacuggucggaaucaagcgcggcgugaaacgggaggaacuuaagcuggagaauuuccaauggagagugaaagcccucucugaacgcaugaacccugaggagcuggcgaucguccuucaggaaauuaacgagcagaucuccaauagcucuggguaucugggagccauuuccgaccggagcaaggaacucuacuuuaacagacagaccguuggccaauaucagauggcugugcuggauaauaaccccaauaucggccugcgcaacaugguguucuaccggcaggacuaucucgacgaguuuaauacgauuugggagaagcaagccgaguuccacaaagagcugacagaagaucuuaagaaagagaucagagacaucgucauuuucuaccagcgccggcugaagucccagaaagggcucaucaacauuugugaauuugagagacgccagaucgagguggaaauugauggaaagaagaaaaucaagaccaucggcucucggguuauuccuagaagcagcccccuguuccaagaguuuaaaaucuggcagacacuuaaugacauugaagugagcguccugggggugaagaacaaacggaagaagcaggaugacaauucuaccacccuccuggauuccgcugagaacaucgacagccugaaacucaauguuucucgcccucuggaugccgacgaaaagagccuucuggccaaagagcuuuucauuagagauaagcugacaaaauccgacgugcugaagcuccucuuuaacaauccgcagaaccugaaccugaauuucaaaaacaucgacggaaaucggacgggcucugcucucuaucaagcguuuagcaagauucuggagaucuccgggcaugaaagcaucaacuucaagaaaucugccgaugagauugucgaacaggugaagaccaucuuuuccgcucuuggauggaauacagagguccugugcuucgacagcgaaaaagagcucgauaagcagcccuacuuuaaacuguggcaucugcuuuacucuuucgagggcgacuccaccccuacaggcgaugggaaccucauucagaagaucgccgaccuguguggauuugaaaaggauuaugccagcauucuggcuaauaucaccuuccaagaggacuacggcucccucucuacgaaagccaucagaaagauucugccccaccuuaaagaugggaaccaguaugacguggcgugcgaauacgcuggauauaagcacagcaaauccucucugaagaaggaggagaucaaaaauaagguucucaaagauaagcuggaacugcuuccuaaaaacagccuccgcaaucccguggucgagaagauucugaaccagauggugaauguuaucaacgccauuaucacaaccuacggcaagccggacgaaauccggauugagcuggccagagaacucaaaaagaaugcuaaagagcgcgaggaacugaccaaguccaucguggauacaaccaaaacacaugaggggauuagagccauccuucagaacgacuucggcaugagccacgucucucggaacgcuauuauccgcuauaagcuguacgaagaacucaaagacaauggauacaagacgcuguauuccaacaccuacaucccuaaggaaaaacuguuuagcaaggauuucgacauugagcacaucauuccccaagccagacuuuuugaugacucuuucuccaauaaaacacucgaggugaaguccaucaacauugaaaaaggcucuaagaccgcguaugauuuuguggaggaaaaguacggggagcagggacugcaggaauaucugaaucggugugagguucucuuccgcgacaaaaagacaaaacugagaaaacuuaagaugcaagagagcgaaaucccugagggcuuuauugaucgggaccugcgcaacacccaguacaucgccaagaaggcucucuccaugcugaaugaaaucugcagacgggucguggccacgaccggggcuauuacagaugagcugcgcgaggacuggcagcuuguggaugucaugaaagaacugaacugggagaaguauaaagugcucggacugguugaauacuucgaggacaaugauggcagacucaucgggcggauuaaggacuggaccaaaagaaacgaccaucgccaccaugccauggaugcgcugacaguggccuuuaccaaggacgucuucauccaguacuuuaauaacaagaaugcuagccuuaaacccgauacgaacgaagccgcuauucggaauaaguauuuccaaaacggcaaagccauucccccuaugucucuggacgaguuuagagccgaggcuaagaaacaccucaacgauacacugaucuccaucaagaccaagaauaaagugguuacaaucaaccugaaucgcaccaagaaaaagaacggaauuaauaaaaagcagcagcagaccccgcggggccaacuucaccuggaaacaguguacgggagccauaaacaguaugucgugaaggaggaaaagguuaacgcguccuucgacgccgcuaaaaucgccacggugaauaagcccgccuacagagaugcucuccugcgccggcuccaggagaacggaaaugacucuaaaaaggccuucaccggcaaaaacagccuggauaagcagccugucuggcuugacgcgaagcaaaaugaaugugugcccgagaaagugaagacagucaugcuggagaccguuuauacagugagaaaaccuauugaugaaaagcucaacguggacaaagucguggacgcucgcauccggaagcugcugcaggauagaaucaaggaguacgggaaugccaaauccgccuuugcuaaccuugacgaaaaucccauuuggcugaacaaggagaaaggaaucaccauuaagcggguuucugugagcggcaucuccaaagcccagucucuccacgaaaagaaggauaaagacgggaauuucauucuggauaaggacagccgcagaaucccggucgauuuugugaacacgggcaacaaucaucacguugcgauuuaucggaaaccugugcucgacaagaaaggacaagcugucuucgaugagaacggcgagcugaaguuugaacuugaggaagugguuguguccuucuuugacgccgucacacgcgugaaucugagccagcccaucaucgauaaagacuacaagagaucugagggguggaaguuccuguuuuccaugaaacagaacgaguacuucguguuuccuaaugaaaagaccggauucgaucccaaagagauugaccuccugaacccugaaaauuaugcccuuaucagccccaaccuguuccggguccagaagauugcuucuaaagacuacguuuuuagacaucaccucgagaccgugguggccgaucgcaaggaacugcaagagaucacauggaagcggauuuccagccucucuauccugaauagaaucauuaaaguccgcgugaaccacaucggccagauuguuaugaucggggaguauuga

SEQ ID NO: 4500 - RNA, 4284 nt, Artificial Sequence
  Cas9 variant
auggccaagcccaaagacuacaccaucggccuggauauugggacaaacagcgugggaugggucguuacggacgaucagaauaacauccucagaauuaagggcaaaaaggcuaucggggcccggcuguucgcggagggaaaaguggcugccgaacgcagauccuuucggaccacacgcagacggcuuucucgcagacgguggcgcauuaagcugcucgaggaacuguucgacaaggagaucgccaaaguggauccuagcuuuuucgcuagacuucacgaauccuggaucucuccgaaggacaaacggaagcgcuauagcgccauugucuuucccuccccugaggaggauaaaaaguuccaugaaucuuaccccaccaucuaucaccugagagacaagcucaugaaagaugaccaaaagcaugauauucgggagaucuacauugcugugcaccagaugaucaaagcccgcggcaauuuucugcaugacgaaagcguugagacauauagauccgggaugagcucucugggaggccgguccgagagaaccauucucagcgugcagacacuggaggaacuuaacgaucuguucgcggaaaaugagggcaccgaagaggccaagcucaacgucgcuucugccgagcagaucaaugacauccugacagggggacaccuuaacgcugacucccaaaaagaaauuggcaaucugcuccugccuagcucuuuucccuccuucgaugacaaggccaaagagaaacaggugaagaaacugaucaagaacguugcgaccaauauuagcaaagccuggcucggguacaaggcugauuuuuccacaauccugaaccuugccaauguggacaaagaucagaagaagauuuucgcuuuugcccugcagggaggcgacgaagaggauaaaguccaagaacucgagucucugcuugagcagagccagaccgacaucguggaucgccugaucgaaauucggcacgccaucgugcucuccgagauugucccuguugggaugacacugagcgaagcuaugaucgacaaguaugaucagcauaaagaggaccugauuacccucaaggcggugaucagaaacacgaaagacaagaagaaagccgcuaagcugcaagccaucuacgaucuuuacgugaauaaccgccacgccgaccuggcuaaagccaugaagcucacaggaauuaaaaagcggucugaacugcuugauccggaggagcugaagaaagcgaucuccagccuccuggacgauucucccgaagcugucgagauuaagcagaugcuggaagagaaaaccuuccucccucugcagagaagcaacaauaacggcgugauccccaaucaacuucaucagguugagcuggacgaaauuaucaagaaacaguccaaguauuacccuuuccucgccgagaaaaaccccgaugaaucugaggaagcccagaagaaggcuccgacaaaacuggacgcccugcuuaccuuucgcgugccuuauuacgucggccccaugauuaccaaggaggagcaagaagcucaggaugggcacagcuucgccuggauggugcggagagacccucaggaucacgaggcgaucacacccuggaauuuugaaaagaagguugacaaaauggccuccgcuacgcaguucaucaagcgcaugaccacaaaggauaccuaucuccugggagaggacgugcugcccgccagcucucucaaauaccaacuguuuacaguccuuaacgaacugaauaaccuccgggugaauggcaagaaacugaccuccgacgagaaggagcaggucauugaagggcuguucaaaaagcagaagacggugaaagcugauaaguuuguuaaauauuggcaggccaagcauaucggagcggacauuaaagugaagggccuuagcgauccuucuaaguucaacuccacaaugagcaccuacaucgacuuuaaaaagauuuucggggaucaacucaaugacgucaacagacagaaugauuuugagaaaaucaucgaauacuccaccauuuucgaggaccgcaagauccuggaagauaaacugcgggccgacuuugcuuggcucucugaggagcagauuaagcagcugugcagacuucggcugcaaggauggggccgccucagcgauaaacugcugacaagacuuaccgacgccgauggccagaacgugcucgaacggcuguggaauagcaacgacaacuucguucagaucgugucugacccgaauauuaaggcuaagaucgagcaagaaaaccagaaacugcucagagaugggcagagcgacgaugccgucgaguccauccuggacgaugccuauacaagcccccagaauaagaaagcuauucgccaagugaugcgggugguucacgacaucgucaaggcgugugauggaaacgugccugccaaauucgcuauugaguuugccagaucucaggaagacgaucccaagcgcacgaccgccagagugaaucagaugcagaagaucuacgaccaaauuuccgaugaggucgugagccagggcguuaaagaacagcuuucugggaugaagucccugaaagaccgguauuaccucuauuucaugcagggaggccgcgacgcuuacacaggggccaagcugaacaucgauagacugagcgacuaugauaucgaccauauuaugccucaaucuuuugugaaagaugacagccuugauaaucggguccucguggcgcgcgcuguuaacaaucagaaguccgacaaggugcccgcccugcuguucggcaacaaagucguggccgaucucggaaucaccguuagagagaugugggacaaguggcagaaacugggcaugauuagcaagcggaaacuuucuaaucugcucacagauccggacgcucugaccgaauaccgcgcccaaggguuuaucagacggcagcugguggagacgucccaggucauuaaacuuaccgcgacaauccugcagagcgaguucccugauuccaagauuaucgaagugcccgcuaaauacaacucuaucgugcgcaagcaauuugaccucuauaaaagcagagaggucaaugacuaccaccaugccauugaugccuaucuguccaccaucguuggaaacuaccucuaucagguguacccuaaucugcggagaauguucguguauggcgaauuuaagaaauucucuagcaacgcugaggaauccgccuacgacgucgugcgccggguuaagucuaugaacuuucuugaugaccugcucagagggacacacggagauaauauuuacugccgcagcaccggcgagaucguguucaaccggaaugacauuaucuccaagcugaaacaggcuuauagcuuuaagcagaugcuggucacgcaagagguguucacgaaaaagucugcccuuuucgaucagaccguuuaccccuccccugaaagagacagcaaaaagcgcucugggcugaucccccggaaaaagggcauggauacagagauuuauggaggcuacuccgggaacaaggacgcguauuuugugcucgccgaagcugucaaagagaagggacacacccugcagaucgugggcguuccgauuagagcccucaauacccugaaaaacagcgcuaauuacucugaaaaacuucuggagaucauuaagccucaggugauguucaacaaggauacagggaagcccaucaaaggaaucaaggacgucaaaauucucauggauaagauccccugucgccaaccugugcuggagggcgaauccuauuacaugcuggccagcuccaaauaccgguauagccuuaagcagauuucucugagccagauguccaugaaguacauccucgacuauauugacgauccgaauuuuaacaaacaugagaugaucaauauugaccagcaagaugaaaaggagugccugcucucuguguacgacgagauccuggaaaagauggauaaguaucuuccccuguucgacaucagauccuuucggaaaaagcugcacgaugggcgcgacgccuucauugcucucccugucgcguccgaggaaaagaaacccggcaagguugaugugaucagaaaagugcugaagggacuucaugccaacgcugacauuacgaaucuggccgagcucggcuuugggaccgccgcucugggagcccucgucucuacaggcgggaucaaaauuagcgaugacgcgguguucaucuaccaguccccuaccggacuguuugaacggcgcguuaaggugucugaccuucugaaauga

SEQ ID NO: 4501 - RNA, 4287 nt, Artificial Sequence
  Cas9 variant
augaagaaaauccugggccucgaccuggggaccacaagcauuggauccgccuacgugcuugaggcugaaaagucugccgagcagacgaaaaucgucuaucugggcaccagaauuauccucagcuccgcggaugcugaaaacuucucuaaggggcugagcugcucccccacaaccgaccggacauuuaaacgcucuaugagacggcgccuucaaagauacaagcagcggcgcagcucccugauucagcaguucaagaaaaucggaaucauuaccaauacagagcaaaucauuagagaaccuaucagcgagacccacgagcuccugcggauucgcucuaaggccguuuccgaaagagugagccuggaggaauuugcccggauccuccugacgauuaacaaacgcagaggcuauaagucuaaucggaaaaccuccaagagcacagaggaggaugggaaacuuguggacgcuauggccgucaccaaggaacugaucaagcucaaaaagacaccgggacaguacauguucgagcgcuuuaaaagaggcaaguaugcugaaaucgauuucuaccccuuugaccugauuaacgagcuuaaacagaucugggaagugcagggccaaaaguauccugauguucugaccgaggaccuccugucuucccugcucaagcagaaaacggggaaggccaaagagcugauuuacagcaaguccgaucuuaaucccgcggaagugccuaucgacuaccagaaaggaaagaagcugcggaaaacaauucucaacaaguauuucgccuacgagucuagaagccuggcugccaccaauaucauccccgucgaacaggugauuacagcuaucguugccauuuguaaacaaaucaacaauuccagcggcuaucuuggggcgauuggagaucgcucucgggugcuguacgccaacaaucagaccaucggccaguaucucuacgagagaaucaaggcuaacccucaugaccgcauuagaggggaagucuuuuauagacaagauuaccuggacgaguucgaccgcaucugggagugccagcagaauuacuauccggccauucugaccaacgaucggaaacaguuuaucagaaaucgcauuaucuucuaccaacggccccucaaguccaagaaaagcgaacuggcuuuuugugaguucgaaucuagagagguggaacacaacggaaagaaauauacagagggccuucauguggccccuaagagcucccccgucuuccagcacuuucgccuguggcagcggcucggccagauugagguuucuccucugagaaaauggaacaagcaaagcaaugaacuuuucgagcagcagaacgacacggaucaggaacggauccugaauaccgaggccaagcaaaaacucuuuuccuaccugaaccugcucgaccaucugacagauaaugagauccuuaacauucugggguauagccccgacaaguggaaaaucaauuuccgcgaaauuaucggaaacagaaccaauaacucuaugaugaaggcuuucuucaauaugaaagagaugacagauggcgaacagauuaacugggagaagaaucucaccaaaaucacgaacgggcagucccugaucagcccggaacagauuguggaccugauccggcaauuuuucgagagagagggaauuacaaccucucuucucuacuuugauccuaccacagacaauuuccgcgaacagucccacuauagccuguggcaccuucucuacuccuacgaggaugacaacucucccaccggcacaacgagccugugcaagacccuugcgaagcgguaugggaucccucaugaacuguguccccuccuggccucccugacauuugagccccaguacggaucucuuagcaccaaagcuaugagaaagauucucccuuucaugcaagaaaacggcuaugacaaagccugcgagcuggccggcuaccgccacuccgcuuggacaaccaaggaggaaaauacggagagaacccugaaaaacagccucccgcugcuucggaaggggucucugcgcaaucccguggucgaaaagauccucaaccagaugacacaugugaucaauacccacauuuccgaguauggaaacccugaugaaaucagaauugagauggcccgggacaugcaggcgaauagcaaacagcgcaaggcuaugacaaccgccaucgccgaggcuacgaaaagaaacacacaauuuauugaagagauccagaaggaauuuggcuucaaucccucuaaaaacgaucugaucaaguacaagcuguggaaagagcuugccccucucggguccaagacccuguauagcaauacauacauucccaaagaggaacuguuuaccgcuaaguucgagaucgaacacauuaucccgcgggcccucuuuuacgacgauucuuucagcaacaaaacccuggagcuuaauuccguuaacaagcugaagggaaauaaaacagcgcucgacuauauggauacgcugagccaggaacaggccaacgacuacauuauccgcguggaggagcugaagaaaauuggcgcuaucacccaagccaaguauaaaaagcugcucaucagagaaaaagaucugggggacgauuuuacaaaccgggaccugaccaauacacgcuacauuaucagacaugcugccgauaugcuccugcaggucaccccuucuauugugcacacgaacggcuccaucacagcgauucuucggagagacugggagcugcucgacauccugaaggaacugaaucuucccaccuaugagagcaucgaucgcaagauuuccgacccuaaagaaaagcugaccgagucuguugagcggaaagauggacaggccaucaagaugauuaaagacuggagcaagagagaugaccaucgccaccaugcuauggaugcccucaucacagcucugaccacacggaagcacgugcaguaccucaacggcaauagaggggccgaagagacggacaaaguccaaaagcugcagcagcuuaaagcccugcgcaagcaacucauuggauccgauggccacuucauucccccuaugcaugacauccgggugcaggcuaaagaagcgcugucuagagucaucaucagcaccaaggccaaggggaaagugacaacccccaacacaaauauuaucuguucccgcgauaagaccacgggacggaaaauuuauguuaagcagaccacacugaccccgagaggcgcccuucacaaagagaugcaguacgggugcaaccauuacuaucuggaaaagcaaaucccuauuggcucuaagcucacagaggaggaaauccggcuggugagcucccccaaaauccgcagcaugcucucugagagacugcaggcuuacaauaacgaccccaaguccgccuuuaccggacggaauagcauggauaaaaagccucuugaagacaaaaacaagaagcuggucuauacagacaaaaaggugaaacagaccauucucgcuaaucgcuucguuaagagagaucgggugaacucuaaacuggaccuggauaaggucaucgacacgggcauuaaaagaauccuugagcgccggcugaagcaguacgggggaaaguaugagacagccuuuuccgaucucgaaaauaacccgauuuggcugaacgaggaaaaaggcaucgcgaucaagagcgugcggauucgcgggaaaaauaacaccaucaccauucggcaaacaaauaccuguagaaucaaguacguggcuaacgacaauaaccaccaccucgccguuuaugcccugcccgauggaucuauugaggacgauaucgucuccuucuuugacgcuguggaacgcagccggaaaggccuuccuaucauugauaagcauaagaaucagucccugggguggaaauuccuguuuagcgugaagcagaacgaguacuuccuccugccccagcaaggcgagaaaaucgacauugacacgggagaaaucucuaugcagacaaccuucagcccuaaggaucuuucccccgaguacauuaugaauccugacaacuaugccgaacuggcgccccacaucuuuagaguccagucuauuagcaaaacaccgcagggcaaucgcgaugugagaaucuaccucuucaagcaacaguauaucuccgggucucagaaggacagccugcaucucaaaggaauuacccaccggcaaaucuccucugcuaaggaucuggccggccuuguuaaaauucgcgugaaccaucuggggagaaucgucgccgugggagagaaguga

SEQ ID NO: 4502 - RNA, 4287 nt, Artificial Sequence
  Cas9 variant
augaagaaaauccugggccucgaccuggggaccgccagcauuggauccgcuuacgugcuugaggccgaaaagucugcggaucagacaaaaaucgucuaucugggcacgagaauuauccucagcuccgcugacgccgagaacuucucuaaggggcugagcugcucccccaccacagaucggaccuuuaaacgcucuaugagacggcgccuucaaagauacaagcagcggcgcagcucccugauucagcaguucaagaaaaucggaaucauuacaaauaccgaacaaaucauuagagagccuaucagcgaaacacacgagcuccugcggauucgcucuaaggccguuuccgagagagugagccuggaagaguuugcucggauccuccugaccauuaacaaacgcagaggcuauaagucuaaucggaaaacguccaagagcaccgaagaggacgggaaacuuguggaugccauggcugucacaaaggagcugaucaagcucaaaaagaccccgggacaguacauguucgaacgcuuuaaaagaggcaaguaugccgagaucgacuucuaccccuuugaucugauuaacgaacuuaaacagaucugggaggugcagggccaaaaguauccugacguucugacagaagaucuccugucuucccugcucaagcagaaaaccgggaaggcgaaagagcugauuuacagcaaguccgaccuuaaucccgccgaggugccuaucgauuaccagaaaggaaagaagcugcggaaaacgauucucaacaaguauuucgcuuacgaaucuagaagccuggccgucacaaauaucauccccguggagcaggcuauuaccgccaucguugcgauuuguaaacaaaucaacaauuccagcggcuaucuuggggccauuggagaccgcucucgggugcuguacgcuaacaaucagacaaucggccaguaucucuacgaaagaaucaaggccaacccucaugaucgcauuagaggggaggucuuuuauagacaagacuaccuggacgaguucgaucgcaucugggaaugccagcagaauuacuauccggcuauucugaccaacgaccggaaacaguacaucagaaaucgcauuaucuuuuaucaacggccccucaaguccaagaaaagcgagcuggccuucugugaauuugagucuagagaaguggagcacaacggaaagaaauacaccgaaggccuucauguggccccuaagagcucccccgucuuccagcacuuccgccuguggcagcggcucggccagauugagguuucuccucugagaaaaugggauaagcaaagcaacgagcuuuuugaacagcagaauaacgcugaccgggaggggauccugaauacagaagcgaagcagaaacucuucuccuaucugaaccugcucgaucaucugacggacaaugagauccuuaacauucugggauacagccccgauaaguggaaaaucaauuuucgcgagauuaucggcaacagaaccaauaaccucaugaugaaggccuucuuuucuaugaaagaaaugacagacggggagcaaauugauugggaaaagaaucugaccaaaaucacaaacggacagucccugaucagcccggagcagauuguggaccuuauccggcaguucuuugaaagagagggcauuaccacgucucuccuguauuucgauccugcuacagacaauuuucgcgagcaaucccacuacagccuguggcaccuccuguacuccuaugaagacgauaacucucccaccgggaccacaagccuuugcaagacccuggccaagcgguacggaaucccucaugagcucuguccccugcuggccucccuuacauucgaaagacaguauggcucucucagcacgaaagcuaugcgcaagcugcugcccuuuaugcaggagaaaagauacgacgaagccugcgagcucgcgggcuaucggcacuccgcuuggauuaccaaggaggaaaaugccaaacgcacacugaagaacaaacuuccucugcucagaaaggggagccugcggaacccgguggucgagaagauccugaaucaaaugacccaugugaucaacacacacauugccgaauacggaaaucccgaugagauccgcauugaaauggcuagagacaugcaggccaacucuaaacagcggaaggcuaugaccgccgcgaucacggaggccaccaaacgcaauacacaguucauugaggaaauccaaaaggaguuuggcuucaacccuuccaagaaugaucuuaucaaauauaagcucuggaaagaacuggcuccccuggggaacaagacccucuacagcaauauuuacaucccuaaagaggagcuguucacagccaaguuugaaauugagcacaucauucccagagcucuuuucuaugacgauucuuuuuccaacaagacccuggaacucaauagcguuaacaaacugaagggaaauaaaacggcccuggacuaccuugauacacucggccaggagaaggcgaacgacuauauccugcggguggaggaacugaaaaagauuggggccaucacccaggcuaaauacaagaagcuccugauccgcgagaaagaucuuggcgacgauuucacaaauagagaccugaccaacacccgguauauuaucagacaugccgcugacaugcuccugcaggucacaccgucuauugugcacacgaacggaagcaucaccgccauucugcgccgggauuggggccuucuggacauccucaaggaacugaaucucccuacauacgaguccaucgauagaaaaauuagcgaccccgaagagaagcugacccaaucuguugaucgcaaagacgggcaggccaucaagaugauuaaggauugguccaaacgggacgaucauagacaccaugcuauggacgcgcuuaucacagcccugaccacgcgcaagcacgugcaguaucucaacggaaauagcggcgcugaagagacagauaaagcccagaagcuggagcaacugaaagcccuucggaagcagcugauuggguccgacggacacuuuaucccucccaugcaugauaucagaguccaggcuaaggaagcccucucucgcgugauuaucagcaccaaagucaagggcaaagugaccacaccuaacaccaauauuaucuguucccgggacaagacaacggggagaaaaauuuacguucggcaaaccacacugacaccccgcggcgcgcuccaccuggacaccaaguacggaaucaacagauauuaccaggagcgggaagugucuauuggcagcaaacuuacccaggaggaaauccgccuggucuccucuccgcauauccagagcauucuccuggagagacugcgggcuuucgauaauaacccuaaguccgccuuuacggggagaaauagcguggacaagaaaccccuugaggauaagaacaaaaagcugguuuauaccgacaagaaagugaagcaaacaauccucgccaaucgcuucgucaaacgggaucaggugaacucuaagcugaaucucgacaaagugauugauaccggaaucaagcggauucuggaaggccgccuucagcaguacgggggaaaauaugagacagcuuuuuccgaccuggaaaacaaucccaucuggcugaacgaggagaagggcaucgccauuaagagcguucggaucagagggaaaaacaaugcgauuccuauccaccaaaccgauacaugcccgauugacuacgucgcuaacgauaauaaccaccaucucgccguguaugugcugcccgacggcaccaucgaagacgauaucgucacguucuuugacgccguggagcgcucucggcagggacuuccuauuguugauaagaauaaaaaccagucccugggcuggaaguuccucuuuagcaucaaacagaaugaauacuuccugcucccccaacaggcugagaagauugacaucgauacaggggaaauuucuacccagaccacauucuccccuaaggaccugagccccgaguacaucaugaacccugauaauuaugccgagcuugcuucccacauuuuuagagugcagagcaucucuaaaacgccccaaggaaaccgcgacgucagaaucuaccuguucaagcagcaguauauuagcggcucccaaaaagauucucugcaucucaaggggaucaccuaccggcagauuagcuccgccaaagaccuggcggaacuugugaagauccgcguuaaucaccugggaagaauugugucugucggcgagaaguga

SEQ ID NO: 4503 - RNA, 4287 nt, Artificial Sequence
  Cas9 variant
augaccaagaaaauccugggccucgaccuggggacaacgagcauuggaugggccuacgugaucgaguccgauaaccccgacgaaucugagauuaagcagaucggcgucagaguuaauccucuuaccacagaugaacaaaccaacuucgagaaagggaagccguuuagcauuaauaaagaacggacacugaagcgcggagcuagacggaaccucgaccgcuauaaggauagacggaauaaccugaucgaggugcuuaaaaaggccaauauccugucccaggacucuauucucaccgaggaaggccagcacacaacccaucagacguggcaacugcgcgcgaaagcugccguggauaagaucgagaaagaagaacuggccagaguccuccuggcuauuaacaagaagcggggguacaaaagcucccgcaaggccaaaaaugaggacgaaggacaggcuaucgauggcauggccguggcgaagagacuuuaugacgagcagauuaccugcggccagcugguuuaccaacuccugcgggaagggaaaaagucuauccccgauuucuaucgcagcgaccuucaggccgaguuugauaaaguguggaacuuccagaagcaguuuuacccuaagauucugacagacgaguucuauaaagagcucaagggaaaaggccaaagagcuaccuccgcccuguuuuacaagacauacaauuucaacaccgcugagaauaaagggagccgggaagagaagaagauccaggccuauaaauggcgcucugaagcgaucucccagcaacuggagaaggaagaggucgccuuugugcucacggagauuaacaauaaccugaacaauagcucuggauaccuuggcgcuaucuccgacagaagcaaagaacuguauuucaacaagcagacaguugggcaguaccucuaucagcaacugcaggagaaucggcacgccagacuuaaaaaccagguguuuuaccgccaggauuaucuggacgaguucgaggcuauuuggaaggaacaagccaagcaucacaccgagcucacagaggaacugaaagccgagauccgggauauuaucaucuuuuaccagagaaagcugaaaucucagaagggacucauuuccuucugugaguucgaaagccgcgagauccagauugacggcaaaaagaagaccaucggccugcgggucgcucccaaauccucuccucuuuuucaagaguucaagauuuggcagaaucugaacaaugugcucgugagaaagaaggggagccgcaaacggaacgucaagcaggaaauccagggaucccuguuugaagaggaaaaagagaucuucguuuuugaucuugagaccaaggaaaagcuguucgaggaacucaaucugaaaggcaaccugagcgcgaauaaggugauugagcuccuggggcauaaacccacagaaugggagaucaacuacucugcccuugagggaaauagaacgaaccaagcucuguauaaugccuaccucaagauucuggacaucgaaggcuaugaugaggaccugcuuaaacucuccgauaaggacgauauuaacguggccgaccugaagaccccugcuagcgaaaucaaaaacaugguccgcgacauuuuucaggugcuggggaucucuacagauauccucgaguucgacgccgaacuggauggaaaggacuuugagcagcaagcgagcuaccagcuuuggcaucugcucuauuccuacgagggcgaugacucucagagcggcaaugaaaaacuguaugagcugcuugaaaagaaauucggguuuaagaaggagcacucccagguucucgcuaacgugacccugagcgaugacuacggaaaucugucuuccaaagccaugcggaagauuuacccguucaucaaagagaacaauuauagcacagccugcgaacucgcuggcuacagacacucuaagcacucccugaccaaagaggaaauugagaaccgcccccuugaugacaagcuggaacuccugaagaaaaauagccugcggcaaccugucguggagaagauccuuaaccagaugguuaauguggucaacucccuccuggagaaaaauagaaaggaaaaccccgauuuucgguucgacgagauucgcaucgaacuggccagagagcucaaaaagaaugcuaaagaacgggccgagaugacgacaaacaucaauucugcgaagaccgagaacgaaaagauuuucaaacugcuucaggccgaguuugggcugaagaacccuaccagaaaugauaucauucgcuaucggcucuacgaagaacugaaaaacaauggauauaaggaccuguacacaaacaaauauauccccagagaaauucuuuucagcaaacagguggacaucgagcauaucauuccgcaaucccgccucuuugaugacucuuucagcaauaagaccaucgucuacagagagacaaaccuggauaaaggcaaucagacggcuuuugacuacauugauuccaaguaugggaacgaaaaaguggaggaauacauccugcggauugaggcccuccacgacgcuuggaagaaaaauaaggaggaaggcaucagcaaggccaaauaucagaagcugcuuaaaaaggagaccgaaaucggagauggcuucauugagcgcgaccugagagaaucucaguacaucgcgaaaaaggccaaggagaugcucuuuaaaauuacacgguccguugugagcaccucuggguccaucacagauaagcugcgcgaggacuggggacugauuaacaucaugaaagaacuuaaucugccuaaguauagaagccucggccugaccgagaugcaagaacggaaauucgggcagaaggucgaggugauuaacgauuggacgaagcgcaaugaccacagacaucacgcuauggaugcccucaccguugcuuuuacaaaacauaaccacauccaguaccugaauuaucuuaacgcccggaagaacgaaaaucauaaacugcacaacaauaucauugccaucgagaaccucgagaccgaaacaaugauugacaauaacggaucuaagcgcagaguguucaaagcucccaugccuaauuuucggcaagucgcgaaggagcaccuggaaaacgugcugaucagccauaaagccaagaauaaggugguuaccaaaaacaagaauaaaauugcuggcaaggucgccgcccaggagacgcuuacacccagagggcagcugcacaaagaaaccguguacggcaaguaccaguauuacgugaacaaggaggagaaaaucggaacaaaguucgacgaagagaccaucaauaaagucuccaacccccaauaucgcaagcuccugcucgaacggcugagcgcuaauggcaacgauccuaaaaaggccuuuucugggaagaaugcgcuuuccaaaaacccgauuuaccugaacgagaccaagacagagacggugcccgaaguugugaaacucaccuggcuggaggaagacuauagcaucagaaaggauauuacaccugacaauuucaaagaugagaaguccaucgacaagauucuggaugaaggagucaaacgcauccuuaagaaacggcugagaaagaacgacaaugaucccaaaaaggcuuucucugaccucgauaaaaacccuaucuggcugaaugaggagaagggcauuagcaucaagcgcgugaccauuuccgggguuaacaaugccgaaccccuccauuacaaaaaggaccacuuuggaaacgacauccuggaugagaaaggcgacaagauuccgguggauuucgucucuacagggaauaaccaccauguggccguuuaucgggacgaaaaaggcaaucuucaggagaacaucgugagcuuuuucgaagcugucauuagagugaaucagggacugccuaucaucgauaaggccuacaaccagcaccugggcuggcaauuucucuucaccaugaagcagaaugagauguuuguguuccccaacgagaaauccggguuuaacccucaggaaauugaccugcuugaucccucuaauaagaaaaagaucagcccuaaccuguuccgcguccagaaaauguccaagguuauuuacggaaauagccccgugcgggaguauguguuuagacaucaccucgaaacgaacgucgacgagaagaaagaacugaaggauaucacauucaaaaauauuaagucucucggcuacuucgaggacaucgugaaaguucggaucaaccaucugggggauauuguguccgucggagaguauuga

SEQ ID NO: 4504 - RNA, 4293 nt, Artificial Sequence
  Cas9 variant
augaagcacauccugggccucgaccuggggaccaacagcauuggaugggccguggucaaagaggcucagaaugauaacgaacaauccgagaucguugacgugggcgugagagucaauccccuuacaacggaugaaaagaccaacuucgagaaagggaagccuauuucuacaaaugccgaccggacccugaaacgcagcgcgagacggaaccuccagcgcuacaagcugagacggaaggaacuuaucgagcugcucaaagagcaucagcugauuuccacagauaccauccugacagaaaauggaaagggcaccacguuucagacccucgagcugcgcgcuaaaucugccaaggaaaagaucagccuugaggagcuggccagaguguuccucacaauuaacaagaagcggggguauaaauccucucgcaaggcuaaaaaugaagacgagggacaacugaucgauggcauggaaauugccaagagacuuuacgaggaaaaccugaccacaggccagcucagccugcagcugcucaaagaggggaagaaaucccugccggacuauuaccggagcgaucuucaguuugagcuggacaagguuuggaauuuccaaaagcaguuucacucugauauccucaccgacgaauuuuaugcucagcugaaaggaaagggccagcgcgccacguccgcgcuuuuucuggccaaauaccaaauuuauacagcugagaacaaggggagcagagaagauaaaaagcuccaggccuaccaguggcggguggacgcucugucuaaggagcugacccgcgaacaacucgccuucgucaucacagagauuaauaacaaucugaacaacuccagcggauaccuuggcgcgaucucugacagauccaaagagcuguauuuuaauaacgaaaccgugggggaguaccucuggaagcagaucgccgcuaauccccauaccagccugaaaaaccagguuuucuaucggcaggauuaccuugacgaauuugagcaaauuuggaagacacaguccgccuucuauccugaaauccugacggaugagcucaaaaaggagcugagagacguggucauuuucuaccagcgcaagcugaaaucucaaaagagccucguguccuucugcgaguucgagaauaaagaaaucgagauuaagaaagaggauggaaccagcacaaagaaggugaucggccugaaagucgcucccaagucuuccccucuuuuucaggaguucaaaaucuggcagaaccugaauaacguucucauucggaagaaaggcagcaagaccaaaaagguggccaagaaucagcaggccgugcuguuugaagaagagaaaacaaucucugaacuggaccuugaggcuaagcaagcccucuucaacgagcugaaucugaaagggaaccucaaggcggauuauugucuggaaauucuuggauacagccccaaagagugggaaaugaauuacuccguccuggagggcaacagaaccaauaaggcucucuaugaagccuaccugaagaucacggaccuggagggguaugaugccaaaaaccaccuuaaggugaaacucaacaaggacgagguugaacuggaugaccugaaagugccugcuucugagauuaaggacaugguccaggccaucuuuaaggaagcgggaaucaauacagauauucuccauuucaacgcugagcuggacggcaaagauuuugaaaaucaggccagcuaccagcuuuggcaucugcucuauuccuacgagggggacgauagcaagucuggaaacgagcugcuguauaaacuucucgaaaccaaguucggcuuuaaaaaggaguacgcccaaauccuggcuaaugugucccugagcgacgauuacggcucucucuccaccaaggccaugcgcaaaauucacccguauaucaaggaaaacaaauucagcacagcuugcgagcuggccggguaccggcacuccaagcacucucuuaccaaagaggaaaaugacaacagaguucugaaggauagccucgaggugcugaaaaagaacucccugcgccagcccgucguggaaaagauucuuaaucagaugaucaaucucgucaacgcgcugcugaaaaaguaucggacagagaauccuaacuuuaaauucgacgaaauuagaaucgagcucgcccgcgagcugaagaaaaaugcugaggaacgggccaacaugacggcuaacaucaauaaggccaagaccgaacaugagaaaauuaucaagauucuuaaaaacgaauuuggacugcccaauccuacaagaaacgauaucauucgcuaccggcucuaugaggagcugaaggcgaauggcuacaaagaccuguauaccaacaucaagaucccccaagaaaaacuuuucacaaaagagauugauaucgaacacauuaucccgaagucuagaguguucgacgacagcuuuuccaauaaaacccugagcuuccggaagacgaaccucgauaaaggggagcgcaccgccuuugacuacauggaaucuaaguucggagcugauaagcuggaggaguacguugccagaguggaagaccucuauaaaaauaacauuaucuccaaggcuaaauaccagaagcugcuuaaaaaggagagcgaaaucggcgauggguuugucgagcgggaccugagagagacacaguauauugccaagaaagccaaggaaauccuccugcagauuaccccuaaugugcugucuacauccggcggaaucaccgaucgccuucgggaggacugggaucugauuaacguuaugaaagaacucaaucugcccaaguacagagcucucggccugacgcaaauggaggaccgcaaauaugggcaacagguggaagucaucacagauuggaccaagagaaacgaccaccggcaucacgcgauggaugcccuuacaguggcuuucaccaaacauaaucacauccaguaccugaacuaucucaacgcccgcaagaaugagaagcauaaagagcacagcaacauuaugggaauccagcagcuggaaaccauuaaggugacagacaaaaauggcaacgagaagagaguuuuuaaagccccuaugcccaauuuccggcaggucacgaaggcuuuucuggaaaacauccuuauuucucacaaggccaaaaauaagguggugaccaaaaacaagaauaaagucgcggggagcaacaaggugcaggagguucugacaccccgcggacaacuccauaaggaaaccguguacggcaaauaccaguauuacguccagaaggaggagaaaaucggggcuaaguucgaccuggaaacaauuaaaaagguggccaauccucucuaucaaucccugcuuaagaaaagacuggaggaaaacggcggagauccgaagaaagccuuuaccggcaagaauagccuggcuaaaaaccccaucuaccucgacgauacgcagacagagcagcugccugaaaagguuaaacuuguguggcuggaaaauucuuucuccauccggaaggacauuacccccgagaacuuuaaggaugaaaaacucaucgacaagauucuggaugagggggucaaacgcauccucaaggaaagacugcagagcuucggaaaugacgccaaaaaggcguucuccgaucuugacaagaacccuauuuggcugaacaaagagaagggcaucaccaucaaacgggugacaauuucugggguugcuaaugccgagccccugcacaccaagaaagaucaucucggaaaggaaauccuggacaaggagggcaaaccgauuccuguggacuuuaucagcacaggguccaaccaccacgucgccguguaucgcgaugaaaagggcaaucuucaagagaaaguggucucuguuuucgaagcuguggugagagccaaccagggacugcccauuaucgacaagacguacaaucagcaucucggcugggaguuucuguucaccaugaaacagaacgagauguuugucuucccuaaugaaagcacaggguuuaaccccaaugauaucgaccuccuggauccuaagaacaagcggauuaucucccccaaucuuuucagagugcaaaaauuuucuaagcugcaguauggaaacagcuucguucgcgaguuuguguuccggcaccaucuggaaaccacagucgaggacagaaaagaacuccagggcauuaccuacaagcagaugaaaaauuccacguucuuuaacgauaucauuaaggugcgcaucaaucaccugggggacauuguuagcaucggagaguacuga

SEQ ID NO: 4505 - RNA, 4293 nt, Artificial Sequence
  Cas9 variant
augaagcacauccugggccucgaccuggggaccaacagcauuggaugggccguggucaaagaggcucagaaugauaacgaacaauccgagaucguugacgugggcgugagagucaauccccuuacaacggaugaaaagaccaacuucgagaaagggaagccuauuucuacaaaugccgaccggacccugaaacgcagcgcgagacggaaccuccagcgcuacaagcugagacggaaggaacuuaucgagcugcucaaagagcaucagcugauuuccacagauaccauccugacagaaaauggaaagggcaccacguuucagacccucgagcugcgcgcuaaaucugccaaggaaaagaucagccuugaggagcuggccagaguguuccucacaauuaacaagaagcggggguauaaauccucucgcaaggcuaaaaaugaagacgagggacaacugaucgauggcauggaaauugccaagagacuuuacgaggaaaaccugaccacaggccagcucagccugcagcugcucaaagaggggaagaaaucccugccggacuauuaccggagcgaucuucaguuugagcuggacaagguuuggaauuuccaaaagcaguuucacucucauauccucaccgaugaauuuuaugcucagcugaaaggaaagggccagcgcgccacguccgcgcuuuuucuggccaaauaccaaauuuauacagcugagaacaaggggagcagagaagacaaaaagcuccaggccuaccaguggcggguggaugcucugucuaaggagcugacccgcgaacaacucgccuucgucaucacagagauuaauaacaaucugaacaacuccagcggauaccuuggcgcgaucucugacagauccaaagagcuguauuuuaauaacgaaaccgugggggaguaccucuggaagcagaucgccgcuaauccccacaccagccugaaaaaccagguuuucuaucggcaggacuaccuugaugaauuugagcaaauuuggaagacacaguccgccuucuauccugaaauccugacggacgagcucaaaaaggagcugagagauguggucauuuucuaccagcgcaagcugaaaucucaaaagagccucguguccuucugcgaauuugagaauaaagaaaucgagauuaagaaagaggacggaaccagcacaaagaaggugaucggccugaaagucgcucccaagucuuccccucuuuuucaggaguucaaaaucuggcagaaccugaauaacguucucauucggaagaaaggcagcaagaccaaaaagguggauaagaaucagcaggccgugcuguuugaagaagagaaaacaaucuucgaacuggaccuugaggccaagcaagcucucuuuaacgagcugaaucugaaagggaaccucaaggcguauuacugucuggaaauucuuggauacucucccaaagagugggaaaugaauuauagcguccuggagggcaacagaaccaauaaggcccucuacgaggcuuaucugaagaucacggaucuggaaggguacgacgccaaaaaccaucuuaaggugaaacucaacaaggaugagguugaacuggacgaucugaaagugccugccuccgagauuaaggacaugguccaggcuaucuucaaggaagccggaaucaauacagacauucuccacuuuaacgcggagcuggauggcaaagacuucgaaaaucaggcuucuuaucagcuuuggcaucugcucuacagcuaugagggggaugacuccaagagcggaaacgagcugcuguacaaacuucucgaaaccaaguuuggcuucaaaaaggaguacgcccaaauccuggccaaugugucucuguccgaugacuauggcagccucucuaccaaggcuaugcgcaaaauucacccguacaucaaggaaaacaaauuuuccacagccugcgagcuggcuggguaucggcacagcaagcauucccuuaccaaagaggaaaaugauaacagaguucugaaggacucucucgaggugcugaaaaagaauagccugcgccagcccgucguggaaaagauucuuaaccagaugaucaaucucgucaacgcccugcugaaaaaguaccggacagagaauccuaacuucaaauuugaugaaauuagaaucgagcucgcgcgcgagcugaagaaaaaugccgaggaacgggcuaacaugacggugaacaucaauaaggccaagaccgaacacgagaaaauuaucaagauucuuaaaaacgaauuuggacugcccaauccuacaagaaacgacaucauucgcuaucggcucuacgaggagcugaaggcuaauggcuauaaagaucuguacaccaacgaauacaucgagaagcaagaccuuuucacaaagaauaucgauauugaacacaucauucccaaauccagaguuuuugacgacucuuucagcaacaagacccuguccuuucggaaaacgaaucucgauaagggggagcgcaccgccuucgacuauaucgaaagcaaauuuggagcggauaagcuggaggaguacguggccagagucgaagaccucuauaagaacaauauuaucucuaaagcuaaguaccagaaacugcuuaagaaagaguccgaaaucggcgauggguucguggagcgggaccugagagagacacaguauauugccaagaaggcuaaagaaauccuccugcagauuaccccgaacguucugagcacaucuggcggaaucaccgaucgccuucgggaggacugggaucugauuaaugugaugaaggaacucaaccugccuaaauacagagcccucggccugacgcaaauggaggaccgcaaguaugggcagcaggucgaagugaucaucgauuggacaaaaagaaaugaccaucggcaccaugccauggaugcucuuaccguggcguuuacaaagcacaaccauauucaguaccugaacuaccucaaugcccgcaaaaacgagaagcacagagagcacuccaauaucaugggcauucaacagcuggaaaccaucaagguuaccgacaaaaacggaaaugagaagcgggucuucaaagcucccaugccuaacuuucgccaggugacaaaggccuuccuggaaaaugugcuuauuagccauaaagccaagaacaaggucgugacgaaaaauaagaacaaaguugcugggucuaauaaggugcaggagguccugacccccagaggacaacuccacaaagaaacaguguauggcaaguaccaguauuacguucagaaggaggagaaaaucgggggcaaguuugaccuggaaaccauuaaaaagguggccaacccccucuaucaaagccugcuuaaaaagcggcuggaggaaaauggaggcgauccuaagaaagcguucacagggaagaacucccuggcuaaaaauccgaucuaccucgacgaugcccagaccgagcagcugcccgaaaaggucaaacuuguguggcuggagaacagcuuuucuauccgcaaggacauuacgccugagaauuucaaagaugaaaagcucaucgacaagauucuggaugagggaguuaaaagaauccucaaggaacggcugcaguccuucggcaacgacgccaaaaaggcuuuuagcgaucuugacaaaaaccccauuuggcugaauaaggagaaggggaucgccaucaaacgcguggcgauuuccggagucgcuaacgccgagccucugcauacaaagaaagaucaccucggcaaggaaauccuggacaaagaggggaagucuauucccguggacuucaucagcaccggcaauaaccaccauguggccgucuauagagaugaaaagggaaaucuucaagagaaaguuguguccguguuugaagcugucgugcgggccaaccagggccugccgauuaucgacaagaccuacaaucagcaccucgggugggaguuccuguuuacaaugaaacagaacgagauguucguuuucucuaaugaaagcaccggauucaacccuaaugauaucgaccuccuggaucccaagaacaaaaagauuaucuccccuaaucuuuuuagagugcaaaaguucucuaaacugcaguacggcaacagcuuuguccgcgaguucguguuccggcaucaccuggaaacaacgguugaggacagaaaggaacuccaggggauuaccuauaaacagaugaaaaauuccgcuuucuucaacgauaucauuaaagugcgcaucaaccaucugggaggcauugucagcgugggggaguacuga

SEQ ID NO: 4506 - RNA, 4293 nt, Artificial Sequence
  Cas9 variant
augaaggacauccugggccucgaucuggggaccaacagcauuggaugggccguggucaaagaggcucagaaugacaacgaaacauccgagaucguugaucuuggcgugagagugaauccccugacgaccgacgaaaagacaaacuucgagaaagggaagccuauuucuaccaaugccgaucggacacucaaacgcagcgcgagacggaaccugcaacgcuacaaacuuagacggaaggaacugaucgagcuccugaaagagcaccagcugauuuccaccgacacaauccucaccgaaaauggaaagggcacgucuuuucagacccuggagcuucgcgcuaaaagcgccaaggagaaaaucucccuggaggagcucgccagagucuuccugacaauuaacaagaagcggggguauaaaucuagccgcaaggcuaaaaaugaagaugagggacagcuuaucgacggcauggaaauugccaagagacuguacgaggaaaaccucaccacaggccaacugucccugcagcuccugaaagaggggaagaaaagccuuccggauuauuaccggucugaccugcaguuugagcucgauaagguguggaauuuccagaagcaauuucauucccacauccugaccgacgaguucuaugcucagcuuaaaggaaagggccagcgcgccacgagcgcgcuguuucucgccaaauaccagauuuauacagcugaaaacaaggggucuagagaagauaaaaagcugcaagccuaccaguggcggguugacgcucuguccaaggagcucacccgcgaacagcuggccuucgugaucacagagauuaauaacaaucuuaacaacagcucuggauaccugggcgcgaucuccgacagaagcaaagagcucuauuuuaauaacgaaaccgucggggaguaccuguggaagcaaaucgccgcuaauccccauaccucccuuaaaaaccagguguucuaucggcaggauuaccuggacgaauuugagcagauuuggaauacacaagcccaguucuauccucagauccucacggaugaacugaagaaagagcugagagacguugugaucuuuuaccagcgcaagcucaagucucagaaaagccuggucuccuucugcgaguucgaaaacaaggagauugaaauuaaaaaggaggauggaaccagcaccaaaaaggugaucggccuuaagguggcucccaaaucuuccccucuguuucaggaguucaagaucuggcagaaucucaacaauguccugauucggaaaaagggcagcaaaaccaagaaagccgccaagaaccagcaagcuguucuguuugaagaggaaaagacaaucucugagcuugaccucgaagcgaaacaggcccuguucaaugagcugaaccucaaggggaaucugaaagcugauuauugucuugagauucugggauacagccccaaggaaugggagaugaacuacuccgugcucgaaggcaauagaaccaacaaagcccuguaugaggccuaccugaagaucacggaccuugaaggguaugaugcuaagaaccaccucaaagugaagcugaauaaagacgaggucgagcuggaugaccucaaggugccugccucugaaauuaaagacaugguucaggcgaucuuuaaggaggcuggaaucaacacagauauucugcauuucaaugccgaacuugacggcaaggauuuugagaaccaggccagcuaccaacuguggcaccuccuguauuccuacgaaggggacgauagcaaaucuggaaaugagcugcuuuauaagcuccuggagaccaaauucggcuuuaagaaagaauacgcucagauccuggccaacgugucccucagcgacgauuacggcucucuguccaccaaggcuaugcgcaagauucacccguauaucaaagagaauaaguucagcacagccugcgaacuugcgggguaccggcauuccaaacacucucugaccaaggaggagaacgacaauagaguccucaaagauagccuggaagugcugaagaaaaacucccuucgccagcccguuguggagaagauucucaaucaaaugaucaaccuggucaaugcccugcucaagaaauaucggacagaaaacccuaauuuuaaguucgacgagauuagaaucgaacuggcucgcgagcuuaaaaagaacgccgaggaacgggcuaacaugacggccaauaucaacaaagcgaagaccgagcaugaaaagauuaucaaaauucugaagaaugaguuuggacuccccaacccuacaagaaaugauaucauucgcuaccggcuguaugaggaacugaaagccaacggcuacaaggaccuuuauaccaauaucaaaaucccccaggagaagcuguucacaaaggaaauugauaucgagcacauuaucccgaaaucuagaguguucgacgacagcuuuuccaacaagacccucagcuuccggaaaacgaaucuggauaagggggaacgcaccgcuuuugacuacauggagucuaaauucggagccgauaagcucgaagaguacgucgcuagaguggaggaccuguauaagaacaauauuaucuccaaagccaaguaccagaaacuucugaagaaagaaagcgagaucggcgauggguuuguugaacgggaccucagagagacacaguauauugccaagaaggcuaaagagauccugcugcaaauuaccccuaacgugcuuucuacauccggcggaaucaccgaucgccugcgggaagacugggaucucauuaaugucaugaaggagcugaaccuccccaaauacagagcgcugggccuuacggaaauggaggaccgcaaguaugggcaacagguggaaguuaucaucgauuggacaaaaagaaaugaccaccggcaucacgccauggaugcucugaccguggccuucacaaagcauaaccacauucaguaccucaacuaucugaaugcccgcaaaaacgagaagcauaaggagcacagcaauaucaugggcauucaacagcuggaaaccaucaaagucaccgacaagaacggaaaugagaaaagaguguuuaaggcuccuaugcccaacuuccgccaggugacaaaagccuuucuugaaaauauucugaucucucacaaggcgaagaacaaaguugucacgaagaauaaaaacaagguggcugggagcaauaaagugcaggagguccucacaccccggggacaacugcauaaggaaacaguguacggcaaguaccaguauuacguucagaaagaggagaagauugggggcaaauucgaccucgaaaccaucaagaaaguggccaacccucuguaucaaucccuucugaagaagagacuggaggaaaauggaggcgauccgaaaaaggccuuuacagggaaauacagccucgcuaagaaccccaucuaucuggacgaugcccagaccgagcagcuuccugaaaaagucaagcugguguggcucgaaaauucuuucuccauucggaaagacaucacgcccgagaacuuuaaggaugaaaagcugauugacaaaauccucgaugagggaguuaagcgcauucugaaagaaagacuucagagcuucggcaaugacgcgaagaaggcuuucuccgaucuggacaagaacccuaucuggcugaacaaggagaaagggaucacaauuaagcgggugaccaucucuggagucgccaaugccgagccccuccacaccaaaaaggaucaucugggcaaagaaauucuugacaaggaggggaagccgaucccuguggacuuuauuagcacaggcuccaaccaccacguugcuguguaccgcgaugaaaaaggaaaucugcaagagaaggucgugucuguguucgaagccgucguuagagcuaaccagggccuccccaucaucgacaaaaccuauaaucagcaucuggggugggaguuucucuucacaaugaagcagaacgagauguuuguguucccuaaugaaagcacgggauuuaaccccaaugauauugaccugcuugauccuaaaaacaagcggaucauuucccccaaucuguucagagugcaaaccaucucugucgugaaguacggcaacgccauuguucgcgacuuuaaauuccggcaccaucuggagacaaccguggaagauaagaaagagcuccaggggaagacauaccagcagaucaaaagccuguccccgcuuaaugacauuaucaaggucagaaucaaccaccugggagauauugugagcguuggcgaauauuga

SEQ ID NO: 4507 - RNA, 4293 nt, Artificial Sequence
  Cas9 variant
augaagcacauccugggccucgaccuggggaccaacagcauuggaugggccuacgugaaagaggcugaaaaugauacagagacguccgaaaucgucgaccuuggcguuagagugaacccccugaccacagaugagaagaccaauuucgaaaaagggaagccuauuucuacaaacgccgaccggacccucaaacgcagcgcgagacggaaucugcagcgcuauaaacuuagacggaaggagcugaucgagcuccugaaagaacaucaacugauuuccgagaacacaauccucaccgaaaauggaaagggcacgaccuuucagacacuggagcuucgcgcuaaaucugccaaggagaaaaucagccugggggaacucgccagaguguuccugaccauuaacaagaagcggggauacaaauccucucgcaaggcuaaaaaugaggaugaaggccagcuuaucgacggcauggagauugccaagagacuguaugaagagaaccucacaaccgggcagcugagccugcaacuccugaaagagggaaagaaaucccuuccggauuacuaucggagcgaccugcaguuugaacucgauaaggucuggaauuuccagaagcaguuucacucugacauccugacggaugaguucuacgcucaacuuaaaggcaaggggcagcgcgccacauccgcgcuguuucucgccaaauaucagauuuacaccgcugaaaacaagggaagcagagaggacaaaaagcugcaggccuaccaauggcggguggaugcucugucuaaggaacucacacgcgagcagcuggccuucguuaucaccgagauuaauaacaaucuuaacaacuccagcggcuaucugggggcgaucucugacagauccaaagaacucuacuuuaauaacgagaccgugggagaauaucuguggaagcagaucgccgcuaauccccauacaagccuuaaaaaccaagucuucuaccggcaggacuaucuggaugaguuugaacagauuuggaauacgcaggcccaauucuacccucagauccucaccgacgagcugaagaaagagcugagagaugugguuauuuucuaucagcgcaagcucaagucccagaaaucucuggugagcuucugcgaauuugagaacaaggaaaucgagauuaaaaaggaggacggcacauccaccaaaaaggucaucggccuuaagguggcucccaaaagcucuccucuguuucaagaguucaagaucuggcagaaucucaacaaugugcugauucggaaaaagggguccaaaacaaagaaagccgccaagaaccagcaggcuguccuguuugaagaagagaagaccaucagcgaacuugaucucgaggcgaaacaagcccuguucaaugagcugaaccucaagggaaaucugaaagcugacuacugucuugaaauucugggcuacucucccaaggagugggaaaugaacuauagcguucucgaggggaauagaacgaacaaagcccuguacgaagccuaucugaagaucacagaucuugagggauacgacgcuaagaaccaccucaaagugaagcugaauaaagaugagguggaacuggacgaucucaaggucccugccuccgagauuaaagaaauggugcaggcgaucuuuaaggaggcuggcaucaacaccgacauucugcauuucaaugccgaacuugacgggaaggauuuugagaaccaggccucuuaucagcuguggcaccuccuguacagcuaugagggagacgauuccaaaagcggcaaugaacugcuuuacaagcuccuggagaccaaauucggcuuuaagaaagaauacgcucaaauccuggccaacguuucucucuccgacgauuaugggaaucugagcacaaaggcuaugcgcaagauuuacccguauaucaaagagaacaaguucucuaccgccugcgagcuugcgggauaccggcacuccaaacauagccugacaaaggaagagaaugacaacagagugcucaaagauucccuggaaguccugaagaaaaauucucuucgccagcccgugguugagaagauucucaaccagaugaucaaucuggugaacgcccugcucaagaaauaucggacggaaaauccuaacuuuaaguucgacgagauuagaaucgagcuggcucgcgaacuuaaaaagaacgccgaggaacgggcuaauaugaccgccaacaucaauaaagcgaagacagagcacgaaaagauuaucaaaauucugaagaacgaguuuggccuccccaauccuaccagaaacgauaucauucgcuaccggcuguaugaggaacugaaagccaauggguacaaggaccuuuacacaaacaucaaaaucccccaagagaagcuguucaccaaggaaauugauaucgagcauauuaucccgaaaagcagagucuucgacgauuccuuuucuaauaagacgcucagcuuccggaaaaccaaccuggacaagggagaacgcacagcuuuugacuauauggaguccaaauucggcgccgauaagcucgaggaauacguggcuagagucgaggaccuguauaagaauaacauuaucagcaaagccaaguaccagaaacuucugaagaaagaaucugagaucggggauggcuuuguggagcgggaccucagagaaacccaguauauugccaagaaggcuaaagagauccugcugcagauuacacgcaauguucuuuccaccagcggaggcaucacggaucggcugagagaagacugggaucucgugaacgucaugaaggagcugaaucucccuaaauaccgcgcgcuggggcuuacagaaauggaggacagaaaguauggacaacagguggagguuauuaucgauuggaccaaacggaacgaccaccgccaccaugccauggaugcucugacaguggccuucaccaagcacaaccauauccaguaccucaauuaccugaacgccagaaagaaugaaaagcaccgggagcauucuaacauuaugggcauccagcaacuggaaaccauuaaggucacagacaaaaaugggaacgagaagcgcguguuuaaagcucccaugccuaauuucagacaggugacgaaggccuuucuugaaaacguucugaucucccacaaagcgaagaauaaggucgugaccaaaaacaagaauaaaguggcuggaagcaacaagguccaggaggugcucacaccccggggccagcugcacaaagagaccguuuaugggaaguaccaauauuacgugcagaaggaagagaaaauuggcggaaaguucgaucucgaaacaaucaaaaaggucgccaauccccuguaucagucucuucugaaaaagcgccuggaggaaaacggcggggacccuaagaaagccuuuaccggaaagaauagccucgcuaaaaacccgauuuaccuggacgaugcccaaacggagcagcuucccgagaaggugaaacugguuuggcucgaaaauuccuucagcaucagaaaggacaucacaccugagaacuuuaaagaugaaaagcugauugacaagauccucgaugagggcgugaaacggauucugaaggagcgccuucagucuuucgggaacgacgcgaaaaaggcuuucuccgaucuggacaaaaaucccaucuggcugaacaaggaaaagggaauuaccaucaaaagagucaccaucagcggcguggccaaugccgagccucuccauacaaagaaagaucaccuggggaaggaaauucuugacaaagagggcaagcccaucccgguugauuuuauuuccaccggaucuaaccaucacguggcugucuaucgggacgaaaagggcaaucugcaggagaaaguggugagcgucuucgaggccguugugagagcuaaccaagggcucccuaucauugacaagacauacaaugaacaccugggaugggaguuucucuucacgaugaaacagaacgaaauguuuguguuccccaaugaguccaccggcuuuaacccuaaugauaucgaccugcuugaucccaagaacaaacgcaucauuucuccuaaucuguuccggguccagacaaucagcgugguuaaguacgggaacgccauugugagagacuuuaaguuccgccaucaccuggaaaccacagucgaggauaaaaaggagcuccagggaaaaaccuaucaacagaucaagucccugucuccccuuaaugacauuaucaaagugcggauuaaccaucugggcgauaucguuagcgugggggaauacuga

SEQ ID NO: 4508 - RNA, 4293 nt, Artificial Sequence
  Cas9 variant
auggcccagaaguacauccugggccucgaccuggggaccaacagcauuggaugggcuguggucaaagaggccgaaaaugauaacgagcaauccgaaaucguugacgugggcgugagagucaauccccuuacaacggaugagaagaccaacuucgaaaaagggaagccuauuucuacaaaugcggaccggacccugaaacgcggagcuagacggaaccuccagcgcuauaagcugagacggaaggagcuuaucaaaauucugaaggagcaccagcucaucagcgaugacacaauccuggccgaaaauggcaaagggaccacauaccagacccugaagcuccgcgccaaauccucuaaggagaagauuagccuggaggaacuugcuagaguguuucugacgaucaacaaaaagcggggauauaaauccucucgcaagaccaaaaaugaggaugaaggccaacucauugacggcauggagaucgccaagagacuguacgaagagaaccuuacaaccgggcagcugagccuccagcugcugaaagaaggaaagaagucccucccggauuauuaccggagcgaccuggagcuugagcuggauaaaguuuggaauuuccagaagcaauuucauucugacauucucacagaugaguucuauacccagcugaaaggcaaggggcagcgcgcuacguccgcccuuuuucuggaaaaauaccagaucuacacaguggaaaacaagggaaauagagaggaaaagaaccuccaagcguaucaguggcgggucgacgcccugagcaaagagcugacccgcgaggaacucgcuuucgugauuacagagaucaauaacaaccugaauaacucuuccggcuaccuuggggccaucagcgacagaucuaaggaacuguauuuuaauaacgagaccguuggagaauaccucuggaaacagauugcugccaauccccacaccucccugaagaaccaaguguucuaucggcaggauuaccuugacgaguuugagagaaucuggaauacacaggcgcaguucuauccucaaauucugacggaaagccucaaaaaggagcugcgcgaugucgugaucuuuuaccagcggaagcugaaaucccagaagucucucgugagcuucugcgaauuugagaacaaagagauugaaaucaagaaugaggacggcaccacaaccaaaaaggucaucggccugaagguugcccccaaauccagcccucuuuuccaggaguucaagauuuggcaaaaccugaauaacgugcucaucagaaagaaggggucuaaaacagaaaagguggcuaaaaaucagcaggucgugcuguuugaagaggagaagaccauuuccgaacuggaucuugaggccaagcaggcucucuucaacgaacugaaucugaaaggaaaccucaaggccgacuacugucuggagauccuuggcuauagcucuaaagaaugggagaugaacuacagcguucuggaggggaaucgcacgaacaaggcccucuaugaggcuuaccugaaaauuacagaucuggaaggauaugacgcgaagaauuaccuuaaggugaaauccaacaaggaugaagucgagcucgacgaucugaaagugcccgccucugaaaucaaggagaugguucaagcuaucuuuaaagaggccggcauuaauaccgacauccugcauuucgacgccgaacucgaugggaaggacuuugagaaccagggaagcuauaagcuguggcaccuucuguacuccuacgaaggcgaugacagcaaaucuggcaaugagcuccuguauaagcugcuugagaccaaauucgggcucaagaaagaauacgcucagauucuggccaacaucucccugagcgaugacuauggaaaucucucuacaaaggcgaugcggaagauucauccuuacaucaaagagaacaaguuuuccaccgcuugcgaacuggccggcuauagacacagcaaacacucccuuacaaaggaggaaaaugagaaacgcgugcugaaggaugggcucgagguccugaaaaagaacucucugcggcagccgguggucgaaaagauucuuaaucaaaugaucaaccucgugaaugcccugcugaaaaaguacagaacggagaaccccaacuucaaauuugacgaaauccgcauugagcucgcucgggaacugaagaaaaaugccgaggagagagcuaacaugaccgccaauaucaacaaggcgaagacagaacaugagaaaauugauaagauccuuaaaagcgaguucggacugccuaaucccacccgcaacgacauuauccgguauagacucuacgaagaacugaaggccaauggcuacaaagaucuguauacaaaccgguacaucuccucugagaaacuuuuuagcaaggagauugacaucgaacacauuaucccuaaaucccgcguuuucgaugacagcuuuucuaauaagaccauuguguauagaacggacaaccuggauaaaggggagcagaccgcuuacgacuauaucgaauccaaguucggcgccgagaaacucaaggaguacaugacacgggucaaggaucuguaucagaaaaagaucauuagcaaagcuaaguaccaaaaacuccugaagaaggaaucugagaucggagacggcuucguggaaagagaucuucgcgagacccaguacauugccaaaaaggcgaaagaaauccugcuccagauuacacauaauguucuguccaccagcgggggaaucacggaccggcugagaaaggauuggggccuugugaacgucaugaaagagcugaaucuccccaaguaucgcgcccuggggcucacaaaaauggaggacagaaaguacggacagcaaguggaagugaucaccgauuggacaaagcggaacgaccugcgccaccacgcuauggaugcccuuaccguugcuuuuaccaaacauaaucacauucaguaucugaacuaccucaacgccagaaagaaugagaaacauaaggaacacaacaauaucauggccauucagcagcuggagacaaucaaagucacggacgaaaacggcaaugagaagcggauuuucaaggcuccgaugccuaacuuucgccaaguggcgaaaaccuuccuggagaaugugcuuaucucucauaaggccaaaaacaaggucgugaccaaaaauaagaacaagauuagcggguccaauaaaguucaggaagugcugacccccagaggccagcuccacaaggagacagucuauggaaaauaccaguauuacgugcaaaaggaagagaaaaucggcgcuaaguuugauagcgaaaccaucgagaagguugccaacccucuguaccagucucuccugaaaaagcggcuugaggaaaaugggggagaccccaaaaaggccuucacgggcaaaaacucccuggcuaagaaucccauuuaucuggacgauacacagaccgagcaacucccugaaaaagugaagcuggucuggcuugagaacagcuuuuccauccgcaaggacauuaccccggagaauuucaaagaugaaaagcugaucgacaaaauucucgaugagggggugaagagaauccugaaagaacggcuccagucuuuuggaaacgacgccaagaaggcguucagcgaucuggagaaaaaccccaucuggcuuaauaaggaaaaaggcauugcuaucaagcgcguuacaauuuccgggguggccaacgccgagccucugcacaccaaaaaggaccaucugggcaaggagauccucgauaaagaaggaaagcccauuccugucgacuuuaucucuacaggcaauaaccaccauguggcuguguacagagaugagaaagggaaucugcaggaaaagguccuuagcguuuucgaggccguggugcgggcgaaccagggacugcccaucauugagaaaacguauaaucaacaccucggcugggaauuucuguucuccaugaagcagaacgagauguucgucuuuccgaaugaaucuaccggguucaacccuaaugacaucgaccuccuggaucccaagaacaaaagaauuaucagcccuaaucuuuuuaaggugcagaaacuggcuacaaagaacuacauguucacccaccaucuggagacaaaauccauugacggagauaugcucaagaauaaaaaggaacugagcggcauccuuuauaacuuuauucagacaccccaaaagcuguacgggaucaucaaaguucgcauuaaccaccucggcgacaucgugucugucggagaguauuga

SEQ ID NO: 4509 - RNA, 4296 nt, Artificial Sequence
  Cas9 variant
augaagagaauccugggccucgaccuggggagcuccucuauuggaugggcccuugugaacgaggcugaaagcaaaaaugagcgguccucuaucgucaagcugggcguucgcgugaacccccucaccguggaugaaagcauuaauuucgagaaagggaaguccaucacaacgaacgccgacagaacccugaaacggucuaugcgcagaaaucuucaccgguacaagcugcgcagagaagcgcucauugagguccugaaggagugcaaauuuaucacagaagauaccauccugagcgagaacggaaaucggacaaccuucgaaacauaucgccucagagugaaggcucugaccgaggagauuucccuugaagaguuugcccggguucugaucaugauuaacaaaaagcgcggcuacaaaagcucuagaaaggccgggggagcugaagaggacacgcucaucgauggcauggacauugcccggaagcuguaugaugcuaaucuuaccccuggcgaacugugucuccagcugcuguccgccgggaaaaaggugcucccggacuucuaccgcagcgaucugcaaaacgagcuugacagaaucugggagaaacagaaggaauauuaccccggcauucugacagcggcccucaaagaggaacugcggggaaagaaaagagaugcugucugggccaucugcgcuaaugccuuuguguggaaggagaccuauacagaauggaacaaugaggagucuaagaacgaacagaucgagaaagaacauaaacuugaggggauuuacuccaagcgcaagcgggacgaagcgaaaaaggagaaucugcaguggagaguuagcggacucaaggagaaacugucucuggaacaacucgugaucauucugcaggagaucaacacccagauuaacaauuccagcggcuaccuugggacgaucuccgaucgcucuaaggaacuguauuucaacaaacagacagucggacaauaccucauggacauccuggacaauaacccuaaugccagccuucggaacauuguguuuuauagacaggauuaccuggacgaguucaaugugcucugggagaagcaggcugaauuucacaaagagcugaccggcgaacugaagaaggagauccgcgauauuaucauuuucuaucagcggagacucaaaucccaaaagggccugaucagcuuuugugaguucgagucucgccagaucgaggucaaaauugacgggaagcggaaaaucagaacaguuggaaaccgcgugauuccccgguccagcccucuuuuucaggaguucaagaucuggcaaauucugaauaacaucgaagugaccgccgucggcaauaagaacaaacagagaaugcagaaugggucuaacgaacccgaugacaccgagcagcucgaacugaauggacggcgcuaccuguaucaagaggagaaggaacuucucgcuaaagagcuguucgugagagauaagaugacaaaacuggacguucuccggcugcuuuuugauaacccugaagaacuggaccucaacuucaagacgauugauggcaauaaaaccggguaccuguuuuuccaggccuacagcaagaugaucgaaauguccggacaugagccgguggacuuuaagaaacccaucgagaagauugucgaacaggugaaaucuguuuucgugcugcuuaacuggaauacagacauccucagcuuugauuccaacaaggagcuggacaaacagagcuauuacaagcuguggcaccuccuguauucuuucgaaggcgauaauaccccuacaggcaacgggugccuuguccaaaagauuauggacuccuacggacugggcaaagaguuugccaagauccucgcuaauauuaccuuccaggaggauuaugggagccugucugcgaaagccauccauaagauccugccccaccuuaaagaaggaaaccaguacgacguggcuugugaguaugccggcuacagacacuccaagagcucccucacgaaggaagagauugccaauaaaguccugaaggauaaacuggaagugcucccucgcaacucucugcggaaucccguuguggagaagauccuuaaccagauggucaaugugauuaacgcuaucauugaggccuacgggagaccggacgaaauccgcguugagcuggcgagagaacucaaaaagaaugcuaaggagcgggaaaaacugacaaagagcaucgccgagaccaccaaaacacaugaggcccacaagaaacugcuucaagaagaguuuggccucaagaacgugggacgcuccgauauucugagauauaaacuguacaaggaacucgagucucggggcuauaagacccuguacagcaacacauauaucccucgcgaaaaacuuuucuccaaggaguuugacauugagcauaucauuccccaggcuagacuguucgaugacagcuucucuaauaaaacgcucgaagcccggaacgucaauaucgagaaggggaaccgcaccgcuuacgauuuugugaaagaaaaguucggagaguccggcacagacaauagccuggacugcuaucugaacaauaucgaggugcuuuuuguuucugggaagauuuccaaaaccaaguacacaaaacugaagaugaccgaacaggauaucccuggaggcuucauugagagagaccuccggaacacgcaguacaucgccaaaaaggcgcugagcaugcucaaugaaauuucucgcugugucguggccaccagcggguccaucacagauaagcugagagaggacuggcaacuuguggaugucaugaaagaacugaacugggagaaguauaaagcucucggccugguggaguacuuugaagacaaggauggaaaacagauuggccggaucaaggacuggagcaagagaaaugaucaccgccaccaugccauggacgcucugaccguugccuucacaaaagagguguuuauccaguauuucaacaauaagaacgcgucucuuaaucccaacaccaacgaauacgccauuaaaaauaaguauuuucaaaacgggcgggcuaucgcccccauuccucugaaugaguucagagcugaagccaaaaagcaccucgagaacacgcugaucuccauuaaggccaaaaauaaggucaucacaaacaauaucaacaaaaccaagaaacgcggaggcgugaauacaaagaaacagcagaccccgcgggggcagcuccaucuggagaccauuuacggaugcuguagacaauaucuuacaaaggaagagaagguuaacgcuagcuuugauguguccaaaaucgcgacggucucuagcuccguguaccgcgacgcccugcucaagcggcugcaggaacaccauaaugaucccaaaaaggcuuucgccggcagaaacucucuggacaaaaagccuguuuggcuugacaaggagcagauucgcaaagugcccgaaaaggucaaaaccgugacauuugagaccaucuacacaauucggaaggagaucagcccugaucugagaguggacaaaaucauugauuccgggguccggaagaugcucaccggccgccugaaggaauauggaaaugacgccaaaaaggcuuucucuaaccucgaugagaaacccaucuggcugaauaaggaaaaaggcauuccgaucaagagaguuacgauuagcgggaucuccaacgcccagagccuucacgugaagaaagacaaggauggaaaaccugugcuggacggcaaugggcggaacauucccgucgauuucgugaacacaggaaauaaccaccauguugcgguguaccgcagaccugucaucgacaagaauggccaaauggugaucgaugagaacgggaaucugaaauaugagcucgaagagguuguggucaccuuuuucgacgcugugacccggguuaaccugggccagcccauuaucgacaaggauuacaaagccucugaaggauggcaguuucuuuucuccaugaagcagaaugaguauuuuguguucccuaacaagaaaacaggcuuuaaucccaaggaaauugaccugcucgaugccgacaacuacgggcugaucagcccgaaucucuucagaguccaaaaauuuacccacaagaacuauguguuccgccaucaccuggagacaacgauuaaagauaccucuuccauccuucggggaaucacauggauugacuuuagaagcucuaagggccuggauuccaucgugaagguccgcguuaaucacauugggcagaucgugagcgugggagaguacuga

SEQ ID NO: 4510 - RNA, 4299 nt, Artificial Sequence
  Cas9 variant
augaagaaaauccugggccucgaccuggggagcaacuccauuggaugggcccuugugaaugaggcugaaaacagagaugaggccucuagcaucauuaagcugggcguccggguuaauccccucaccguggacgaaaugcagaacuucgagaaagggaaguccaucacaacgaaugcggaucgcacccugaaaagaucuaugcggcgcaaccuucaaagauacaagcugcggcgcgacgcucucauuaagcugcugaaaaaggugggauuuaucgccgauggcacaauccucagcgaacaggggaauagauccaccuucgagacauaucggcugcgcgccaaagcuccugacgaggaaauuucucuucaggagcuggccagaguccuccugaugaucaacaagaaacggggauacaagagcucccgcaagauuaaagaaaaggaggcuggcacccuuaucgauggcaugaaaguggccaagaaacuguaugacgaggaucucacaccggggcagcugugccugcaacuccuggaaagcggaaagaaaucucuucccgacuuuuacuccagcgaucugcaggaggaguucgacagaauuuggaauuuucagaagcaguucaacccuaaggcguuuugugauaccgccaaagaggaaaucaagggcaaaaauaagucucaaacgugggcuauucucgccaaauauuucaucuggaccgacgagaugguuguguggaacgagaaggaauccaagacagagcgggucgaaaaagagugcaagcugguggggcuuaaacgcaccguuaagaaagaagaacagagaaaggagaauuaccgguggagagugcaggcucugacagaacagcucgaccugggaaaggucgccguggugcugcaagagaucaacggccagauuagcaccucuuccggguaucucggagcgaucagcgaucgcuccaaaguccuguacuuuaaucggcagacgguuggccaauaccagauggccgaacuugagaagaaccccaacacaucucugagaaauaugguguucuaucgccaggacuaccucgaugaauuugacaaaauuugggagaagcaggcugaguuccacaaagaacugaccguggagcuuaagaaggaaauccgggauauuaucaucuuuuaucaaagacgccugaaaagccagaagggccucauuggguucugugaguucgagaaccgggaaaucauggucgagaaaaauggaaagaugcaggccaaagugguuggcugcaaggugauuccuagaucccauccccuguuucaggaguucaaaaucuggcaaacacugaacaaugucgaaguguuugcuggggaaaagaaguguaaacgcaagcggaccgacgccuucccuggacucuuugauggcaccgaggacacacugaugguugagggguggagauaccuuuaucaggaagagaaagaaauucuggccaaggagcucagcgugaaaaagucucugaagaaagaauacauccugaaacuucucuucgauaacccgcaggaccuggauaugaauuuugagcagaucgagggaaacgacacgggcaauguccuguucuccgcuuauagcaaaaugauugaaaaguacggcuacgagccccucgacuuugggaaaucuaccgaugaaaucauugagcgccugcaagugaucuucacagaccuuggauggaacaccgaucugcucuuugucgaccugaauaaggaaggcaaggaucuggagaaacagccuuauuucaaacuuuggcaccuccuguacagcuuugagggggacaacacacccaccggaaauggcaagcugguggaaaagcucauggagcugugccauguugggaaagaaugugcgcuugagcuggugaacauuuccuuccagaaugauuauggcucucucagcgccaaggcuaucaagaaaauucugccuuaccugaaggagggaaaccgguaugacgucgccugcggcuacgccggguauagacacuccaaaagcucucuuacgaaggaagagaucgaaaacaaagugcucaaggauaaacuggacauccugcccaaaaauucccuccggaacccgguuauugagaagauccugaaucagauggugaacgucauuaaugcuaucauugauacauacggaaagccugacgaaauccgcguggagcuugccagagagcugaagaaaagcgcgaaggaacgggaugagcucaccaaagcuaucgccaagucuaccagagaacaugaggaaauucgcaaggugcugcaagaggaguucggcaugaucaacguuucccggaaugacauuaucagauacaaacuguaugaggaacuuaaggacaacggguacaaaacacucuauagcaaucaguacauucccaaggaaaaagucuuuuccaaggagaucgauaucgaacacauuaucccucaggcccgccuguucgacgauucucugagcaacaagacccucgaguauaaagcuauuaauaucgagaagggaaacaaaacagccuacgacuuugugaaggaaaaauauggcgagaaggggcugcaacaguaccuuaauagaugugaaucccuguucaagggccaccggacgaaacuccgcaagcugaaaaugggacaggagaacauucccgagggcuuuaucgauagagaccugcggaauacccaguacaucgcuaagaaagcccuugcgaugcugaacgaaauuugccgcagaguggucgccacaaccgggucuaucacagaucggcuccgcgaggacuggcaacugguggauguucucaaggaacugaaccuucccaaguaugagacccugggacucguggaagucuacgaggacaaagauggcagaaagauuaaacggaucaaggacuggacgaaacgcaaugaucauagacaccaugcuauggacgcccugaccguggcuuucacaaaggacguuuuuauucaguauuucaacaauaaaaacgccgcguggcaggccgauuguaaggagcacagcgacaucauugggaucaagacccgguacuuugaaaauggcagagcucugccuccgaugccccuugugcgcuuccgggccgaggcuaaaucccaccuggaaacacuccuggucagcaucaaggccaaaaacaaggugguuaccaauaacgugaauugcacgaaaagaaagggaggggagaacaagaaacuccagcaaacaccucgcggccagcugcaucuugaaaccauuuauggaucucaccggcaguacgucaugaaggaggagaaagugaaugccuccuuugauagcucuaagaucgcuacagugugcaaacaggcguauagaaacgcccugcucgaacgccuggcugccuucggcaaugaccccaagaaggccuuuaccgggaaaaacucccuggagaagaauccugucuaccuugaucgggaacaaaccgcuagaguucccgagcgcgugcggacaguggaacuggagacggucuacaccauuagaaaaccgguggacccuaaccucagcguugauaagguggucgacgccaaagugcggucuauccuggagcagcgccucagagaauaugauggagaggcgaagcgggcuuucguuaaccuggacgaaaaucccauuuggcuuaacgaggagaagggcaucgccaucaaacgcgugacaauuagagggaucaauaagguccagagccugcauggaaagaaggauaaaaacggcaaucugauucucgacgaaaccgggaagaaaaucccuguggacuucguuaacacaggcaauaaccaccauguggccauuuaccggaagcccguccuggauaagaccggacaagagaugcuugacaaugaaggcaacccuguguaugagcuggaugaaguggucguuuccuuuuucgaggcugugacgagagugaaucucgggcugcccgucaucgacaaaaacuacaauaagagcgagggauggcaguuuauguucacaaugaaacagaacgaauauuuuguguucccgaaugagaagaccggcuuugauccuaaagaaguugaccuccugaaccccgagaauuacgccgugaucucucccaaccuuuuccgcguccagaagauuaccgaaaaggauuauauguuucggcaccaccuggagacaaaagugguugacgauaaguuccugaaagagaucaccuggaagcgcauucucacaccuaacaaacuggaagggaucgugaaggucagagugaaucauauuggacaaaucgucuccgugggcgaguacuga

SEQ ID NO: 4511 - RNA, 4299 nt, Artificial Sequence
  Cas9 variant
augaagaaaauccugggccucgaccuggggagcaacuccauuggaugggcccuugugaaugaggcugaaaacucugaugaggucagcuccaucauuaagcugggcguuagagugaauccccucaccguggacgaaaugcagaacuucgagaaagggaagucuaucacaacgaaugccgaucggacccugaaacgcagcaugagacggaaccuucaacgcuacaagcugagacgggacgcgcucauuaagcugcugaaaaaggucggauuuaucacagauggcaccauccucuccgaacaggggaaucgcacaaccuucgagacauauagacugcgggcuaaagccccugacgaggaaauuucucuucaggagcuggcccgcgugcuccugaugaucaacaagaaaagaggauacaagagcucccggaagauuaaagaaaaggaggcuggcacccuuaucgauggcauggagguugccaaaaagcuguaugacgaagaucucacgccggggcagcugugccugcaacuccuggagagcggaaagaagucucuucccgacuuuuacuccagcgaucugcaggaagaguucgaccgcauuuggaauuuucagaaacaguucaacccuaaggcuuuuugugauaccgccaaggaagagaucaaaggcaagaauaaaucucaaacaugggcgauucucgccaaguauuucaucuggaccgacgagaugguggucuggaacgaaaaagaguccaagacagaaagaguggagaaggaaugcaaacugguugggcuuaagcggaccgugaaaaaggaggagcagcgcaaagaaaauuacuguuggagaguccaggcucugacggagcagcucgaccuggaaaagguggccgugguccugcaagagaucaacggacagauuagcacaucuuccggcuaucucggggcuaucagcgaucgguccaagguucuguacuuuaauagacagaccgugggacaauaccagauggccgaacuugagaaaaaccccaacacaucucugcgcaauaugguguucuaucggcaggacuaccucgaugaguuugacaagauuugggaaaaacaggcggaguuccacaaggaacugaccgucgagcuuaaaaaggagaucagagauauuaucaucuuuuaucaacgccggcuuaagagccagaaaggccucauuggcuucugcgaguucgagaacagagaaaucaugguggagaagaaugggaaaaugcaggccaagguugugggauguaaagucauuccucgcucccauccccuguuucaggaguucaagaucuggcaaacccugaacaauguggaaguuuuugcuggcgagaaaaagugcaagcggaaaagaacagacgccuucccugggcucuuugauggaacggaagacacccugaugguggagggcuggcgcuaccuuuaucaggaagagaaggaaauucuggcuaaagagcucagcgucaagaaaucucugaagaaggaguacauccugaaacuucucuucgauaacccgcaggaccuggauaugaauuuugaacagaucgaggggaacgacacaggaaaugugcuguucuccgccuauagcaagaugauugaaaaauacggcuacgagccccucgacuuuggcaagccuaccgauaaaaucauugaacaacugcaggucaucuucgccgaccuuggguggaacacagaucugcucuuuguggaccugaauaaggagggaaaggaucuggagaaacagcccuauuucaagcuguggcaccuccuguacucuuuugaaggcgacaacaccccuacggggaauggaaaacugguugagaagcucauggaacugugucaugugggcaaagagugcgcucuugagcuggucaacauuagcuuccagaaugauuaugggucccucucugcgaaggccaucaagaaaauucugcccuaccugaaggaaggcaaccgguaugacguggcuuguggauacgccggcuauagacacagcaaauccagccuuacaaaggaggaaaucgagaacaaaguucucaaggauaaacuggacauccugccgaaaaauucucuccgcaacccuguggucgaaaagauucugaaucaaauggugaacgugaucaaugccauuaucgauaccuacgggaaacccgacgagauucggguugagcuugcuagagaacugaagaaauccgccaaggagcgggaagaacucaccaaagcgaucgcuaagagcacacgcgaacaugaggagaucagaaagguccugcaggaagaguucggaaugauuaacgugucucggaaugauaucauuagauacaaacuguaugaggaacuuaaggacaacggcuacaaaacccucuauuccaaucaguacaucccuaaggaaaaaguguuuagcaaggagauugacaucgagcacaucauuccccaagcccgccuguucgaugacucccugucuaacaagacacucgaauauaaagccaucaauauugagaaggggaacaaaacggcuuacgauuuugucaaggaaaaauauggagagaagggccugcagcaguaccuuaaucggugcgagagccuguucaaggggcagagaaccaaacuccgcaagcugaaaaugggccaagaaaacauccccgagggauuuauugacagagaucugcggaauacacaguacaucgccaagaaagcucuugccaugcugaacgaaaucugucgcagagugguugcgaccacaggcuccauuaccgaccggcuccgcgaggauuggcagcugguggacguccucaaggaacugaaccuuccuaaguaugagacgcuggggcucguggagguuuacgaagauaaagacggaagaaagaucaaacggauuaaggauuggaccaaacgcaaugaccacagacaucacgccauggaugcucugacaguggccuucaccaaggacgucuuuauccaguauuucaacaauaaaaacgcugccuggcaagcggacugcaaggagcauucugauauuaucggcauuaagacacgguacuuugaaaaugggcgcagccugccgcccaugccucuugugagauuccgggccgaggcuaaaucccaccuggaaacccuccugguuagcaucaaggccaaaaacaagguggucacgaauaacgugaauugcacaaaaagaaagggaggcgagaacaagaaacuccagcagucuccccgcgggcagcugcaccuugagaccaucuauggcucccaucggcaauacgugacaaaggaagagaaagucaaugcuagcuuugacucuuccaagauugccaccguuuguaaacaggccuauagaaacgcucugcucgaacgccuggcggccuucggaaaugauccuaagaaggcuuuuaccggcaaaaacagccuggagaagaaucccguguaccuuaaccgggaacagacagccagagugccggagcgcguccggacgguggagcuggaaaccguuuacacaaucagaaaaccuguggaccccaaccucucugucgauaaggugguugacgccaaagugcgcagcauucuggagcaacggcucagagaauaugauggggaggcuaagcgggccuucgucaaucuggacgagaacccuaucuggcuuaaugaagagaagggaauugcgaucaaacgcgugaccaucagaggcauuaacaagguucagucccugcacgggaaaaaggauaaaaauggaaaccugauccucgacgaaacaggcaagaaaauucccguggauuucgucaauaccgggaacaaucaucacguggcuaucuaccggaagccugugcugaacaagacgggccaggagaugcuugacaaugaaggaaaccccgucuaugagcuggacgagguuguggugagcuuuuucgaagccgucacacgcgugaaucucggccugccgguuauugauaaaaacuacaauaagucugagggguggcaguuuauguucaccaugaaacaaaacgaauauuuuguguucccuaaugagaagaccagauuugaccccaaagaagucgaucuccugaaccccgagaacuacgccgugaucuccccuaaucuuuuccggguucagaagaucacagagaaggacuauauguuuagacaucaccuggaaaccaaaguggucgaugacaaguuccugaaagagauuacauggaagcgcauccucacgccgaacaaacuggaaggaauugugaagguccgggugaaucacaucggccagauuguuagcgugggggaguacuga

SEQ ID NO: 4512 - RNA, 4299 nt, Artificial Sequence
  Cas9 variant
augaagaacauccugggccucgaccuggggaccacaagcauuggauucgcccacaucguggaggaugaaaauaaagagaaguccgaaauuaaagagcuuggcgucagaaucguuucucugacgaccgacgaacagagcgauuuugagaaggggaaauccauuacaaccaacgcuaaucggacacucaagcauggagcccgccugaaccuugacagauaccaacagcggcgcaaguaucugaucgaucuccugcacaaagcgaaucugaucacccccucuagcauucucgcugagaacggcaagaauacaacccauuccacguggcagcugagagccaaagccgugaccgaacggaucgagaaggaagaguucgcucgcauucuucuggccaucaacaaaaagagaggguacaagucuagccggaaagcuaagacagaggacgaaggacaggccauugauggcauggcgaucgccaaacgccucuaugacgagaaucugaccccuggccaacuuucccugcagcuccugcagcagaacaagaaacugcucccggauuuuuacagaagcgaccugcaaaaggaguucgaucuuguguggaauuuucagaaacaguucuaucccgacauucugacagauaucuuuuacaaggagcuccaggggaagggaaaagacgcuaccucuaaggccuucuccaaacgguaucacuuugacacggcugaaaacaagggcagcaaagagucuguccgccugcaagccuaccaguggagagcggaggccguguccaagcagcuuagcaaggaagagguugcuuacgugcugacagaaaucaauaacaaucucaacaacgccucuggguaucugggagcuauuuccgaucggagcaaagagcuguacuucaaucgccaaaccgucggccaguaucucuacgcccagcugcaggaaaacagacauaauucccuuaagaacaaaguguuuuaucggcaagacuaccuggaugaguucgagagaaucugggaaacacaggcccucuuucacaaggagcugaccgacgaacuuaaaaagcagauucgcgauguugugaucuucuaucagcggaagccuaaaucucaaaaggggcugauuagcuucugcgaguuugaauccaaagagaucgagaucgaaaaggacggaaaaaccauuacaaagaauaucggcgcuagagucgugcccaagagcucuccucucuuccaggaguuuaaaauuuggcagauccugaacaaugugauuuguaagcgcaaaggcauccggaagaaaaagaucuccgcgaaaacgacccagcuggaucuccugaacgaaagcucucaaacaauuuucagccuugacauggagugcaagcagcugcucuuugaugagcugaaucugaagggggaccuuaaauccgauaagguccucaaacugcugggauacucuccccaggaaugggagaucaacuacaaucagcucgaaggcaacagaacccaaaaggcccuguaugaggcuuaccuuaaaauuguugaaauggaggcccacgacgugaaggacauccugcagauuaagagcacaaaagaugacuggucccucgaugagagcccucugucugccuccgaaauccgcgagagcgugaaggcuauuuuccaggcccuggggaucuguaccaaaauccuuuauuuugacccgcuccugcccgucaaggauuucgaagaacaagacucuuaccagcuguggcaucuccuguauuccuacgaaagcgaugacuccacgucuggaaaugagacacuuuaucggauucuggagaaaaaguacgcguuuaagagagaacacgcucgcauccucgccaacguggcccugcaggaugacuacggcagccuguccaccaaagcuauucggaagaucuauccuaauauuaaagagaaccaguacucuaccgccugcgaaauggcuggguauaagcauagcaaacuuucccucacaaccgaggaacuggaggccagagagcugaagaacaucaucccccuccugaagaaaaaugcgcuucgcaacccuguuguggaaaagauucugaaucaaaugaucaacgucgugaaugcccucauugagaaaaacagcgaacgggaugcugagggaaagaucacaaaauacuuccacuuugacgagauuagaaucgaacuggcccgggagcugaagaaaaaugcucagaagcgcuaugaaaugacgcagaacaucaauaaggccaaaucugagcaccagaagauuuccgaaauccuucaaaaagaguucggcauuaagaaccccaccaaaagcgauaucauuagauaccggcucuauaaggagcuggaacauaauggcuacaaggagcuguacacaaacaccuauaucgcgccggacguucucuuuucuaaaaauaucgacauugaacacaucgugccuaaggccagagucuucgaugacuccuucagcaacaaaacacuggcuuuuaaggauuucaauauuaaaaagggggagucuaccgccuuugacuacaucacgagccuuaagaacgaagagaaacugaaccaguaucucgcucgcguggagaaugccuacaagaccaaaaacauuucccccgccaaguauaaaaaucugcugaagaaggcuagcgaaaucggagauggcuucauuaaccgggaccuuagagauacacaguacaucgcgaaaaaggccaaagagauccuguuucaggucaccaagaaugugcucucuacauccgggagcauuaccgaccgccugagagaagauuggucccucguugacgugaugaaagagcugaacaugccuaaguaucaaucucuuggacugacggaagucgaggagcggaaggauggcaauaaagugacaguuaucaaggacuggaccaaacgcaacgaucauagacaccaugcuauggacgcccucacaguggccuucaccaagcccagcuacauucaguaccugaaucaccugaacgcucggaaagacgaaaauaacaagaauuauuccgucauccuugccauugagaaaaaggaaaccaucaaggugcccacaaacaaugggaaaaacaagcgcguguuuaucgagccuauuccgaacuucagacagguugcgaaaaagcaccuggaggaaaucuuuauuucucauaaagcuaagaauaaggucgugacgaaaaacaccaauaagcccgccggcacaaacaaacaacagaucacccucacaccucggggacagcugcacaaggagaccauuuacggcaaauaucaguacuaugugaauaaggaagagaaggucggggugaaauucgauaaggaaacgaucgccaaaguuagcaacccccucuaccgcgaggcucugcuuaagagacugcaagccaaugacaacgauccuaaaaaggcguuuacaggaaagaaugcucucuccaaaaaccccaucuaucuggacgaggccaagaccaaaacccugccggaaaaggugaaucuuacauaccuggaggaagauuucucuguccggaaaaagauugugccuaaaaaccccaccagcaaggaguuuguuccuaaucucaaguccaucgaaaaaguggucgacgagggcgugcgcaacauucugaucgagagacuccggguuuacaauaacgaucccgaaaaggccuucguggaccuggagaaaaauccuauuuggcuuaacaaggaaaaagggaucgcuauuaagagagucacaaucagcggagugaacaaugcccagccccugcauaucggcaaggaucaccuggggaaaacgacccucaacaaggagggcaaagaaauuccgguggacuaugucucuacaggaaauaaccaccauguugcuaucuaccgcgauaaggagggcaaucugcaggagcagauuguguccuucuuugaagccgugguccggacccaacaggggcuuccuaucauugacaaaacauauaagcaggaggaaggauggcaguuccuguuuaccaugaagcaaaacgagauguucguguuucccaaugaggcgacgggcuucaaccccgccgaaaucgaccuccuggauccuaaaaauaagaaacagaucagcccgaaccucuuuagaguucagaagauugcuaccaaagacuacuucuuucgccaccaucuggagacaaauguggaaaccgauaacguccuuaagaauacaaccuggaagcgggaggggcugucuggacugaaagacaucgugaagguuagaauuaaccaccucggcgauaucguguccauuggggaauauuga

SEQ ID NO: 4513 - RNA, 4302 nt, Artificial Sequence
  Cas9 variant
augaagaaaauccugggccucgaccuggggaccacaagcauuggauacgcccaggugaacgaguccgaagauuucaaggacucuagcaucgagagaauuggcguccggguuaauccccuuuccguggaugaacaaacgaacuuugagaaagggaagccuaucucuauuaaugcugaccgcacccugaaaagcggagccagacggacacucgaucgcuaucaggacagacgguccaaccugaucgaugcgcuugugaagucugucaucauuaccgaagacacagugcuggcugaggauggcaagaauaccacacacagcaccuucgcccuccgcgccaaauccgcuagcgagaagguugaaaaagccgaguuugcuagaauccugcuggccauuaacaagaaacggggguacaagucuucccgcaagacgaauaacaaugacgaugaaggacaggcgaucgacggcauggccauugcuaaaaagcucuaugaugagaaccugaccccgggccagcuugccuaccaacugcucaaagaggggaagaaauaucugcccgacuucuacagaagcgaccuucaggcugaauuugauaagaucuggacauuccagaaacaguuuuauccugagauucugaccgacgaacuccaaaaggagcuggccggaaagggccagcgggcgacaucugccaucuucuggaaaaaguacgauuuuaauaccgcugaaaacaaagggacgcgcgaggagaagaaacugaaggccuacgaauggagauccacaagcguggacaagaaacuccagaaggaggaagucgcuuaugugaucaccgagauuaauaacaaucugacaaacucuuccggauaccuuggcgccaucagcgaucgguccaaagaacuguauuucaacaagcagaccguugggcaauaccucuuuaaacagauucagaagaauccccauaccaagcugaaaaaccaaguguucuaucgccaggacuacuuugaugaguucgagaucauuugggaaacacaggccaaguuccacccugagcuuacggaagaacugaaaaauaagaucagagacaucauuaucuuuuaucagcggaaacucaagucucaaaagggacugauuagcuucugcgaauuugagagaaaagaggucgaaaucgagaagggcggccgccggaugaaaaagaccauugggcugaaaguggcucccaaguccagcccucucuuccaggaauuuaaaaucuggcaagugcugaacaauguccuuaucagaaagaagggaucuaaaaagcgccggguuaaagagccggaucagcugaaccucguggagcaggaacaggaggugauguucuuugacaugcagacaaagcagacccuguucgaugaacuuaaugucaaaggcaaccugaaggcgaagagaauuaucgagcucauugggcaagacgccaaugacugggaaaucaacuacuccgagauugagggaaaucgcacaaacaaagcucuguacgaugccuaucugaagauccucgaccuggaaggcuacgauaccaaagcccuucuggacgugaagacgagcaaagaugagguugaacucgacgauauuaauaucucugggcccgaggugaaggaccuggucaagcggaucuuugaaagccuggagauugauacacagauccuugaguucgacgcugaacucgauggagagguguuugaaaaacaguccucuuaucugcuguggcaucuccuguacagcuaugagggcgacgauuccccuagcggcaacgaaaaacuuuacaaacugcucaagcagaaauucggguuuaagaaggagcacgcccaaauucuggcgucuaucacccuguccgacgacuauggaagccuuucugcuaaagccaugagaaagauuuaccccuacauccgcgagcagaccuucgauaaagccgcuucccucgccggcuaucggcauagcgcuuccucucugacaaaggaagagaucgccaauagaccucugaaagacaagcucgaacugauuaaaaagaacagccuucgcaaccccguuguggagaagauccugaaucaggucgugaacauugucaauucccucaucgaggcgaacucugaaaaagauagcgacgggaauauuaucuccuacuucaaguuugaugagauccggauugaacuggccagagaccugaaaaagaacgcuaaagagcgggccgaaaugacccuuaauaucaacgcugccaagauugugcacgagaagaucuucaaacuccugcaagcggaguuuggaguuaagaauccgacacgcaacgauauuaucagauauaaacuguacgaagaacucaagaauaacggcuauaaagaccuguacacgaauaucuauauuccucgggaaauccuuuucagcaagcagauugauaucgagcacauuaucccccagucuaagauguuugacgauuccuucagcaacaaaaccauuguguuuagaaaggacaaucuggauaaagggaacucuacagccuucgacuacaucgacucccgcuuuggcaaggauaaacucaccgacuucgaacagcggaucgaguuucuguucgagcaaggaaagaagaacaaagaagagggcauuagcaaggcuaaauaccagaagcugcuuaaaagagaagccgauaucggggacggauuuauugagcgcgaucucagagacacacaguauaucgcuaagaaggcccggaaucugcuguacgaaauuugucgcaucgucaccccuacgaccggcucuaucacagauagacuccgggaggacugggaucuggugaacauuaugcaggagcuuaaucuggacaaauucaagaaacucgggcugaccgaaaugguugagaagaaagauggcagcuucaaggaacgcaucguggacugguccaaaagaaacgaccaucggcaccaugccauggaugcucugacaauugcguuuaccaagcacagccacauccaauaucuuaauuaccugaacgcccgcaagaaugagaaccauaaacagcaccauaauauuaucggaaucgagagaaaggaaacggaguucgucauugacgaucucgggaacaaaaagcggaaauuucaucugccccuccccaauuuccgcgaagaggcuaagaagcaccuggaaaacgugcuugugucuuuuaaagccaagaauaaaguugucacaaagaacaaaaauaagaccgccuccagcaagggcgagaaaaucaagguggagcugacaccuagaggacagcuccacaaagaaaccguguauggcaaguacaaauucuaugucuccaaggaggaacggauugggggaaaguuugaccagagaaccaucgagcgcguggcuaacucuacacacaaacggcugcugcuucaaagacugcucgaaaacgauaaugacgccaagaaagcguucacgggcaagaacgcucuggccaaaaauccgauuuaccucgaugacaccaagacacugacccuucccgagaucguuaaacugacauggcucgaggaagauuacagcauucgcaaggacaucaccccugagaacuuuaaggauaucaaagugauugacaagauccuggaugaaggggucaaacggauucugaaggagagacuugccaaacauaauaacaaucccaaggaggcuuucuccgaccuggagaagaacccuaucuggcucaaugagaaaaagucuauuagcaucaaaaaggugaaaaucuccggaauuaacaaugccgaagcgcugcacuauaagaagaaccaucucggcaucgagauucuggacgaugagaaaaagcgcauccccguugacuuugugucuacggggaauaaccaccacgucgcuauuuaccgggaugagaaaggcaaucuucaggaggacgugguuagcuucuucgaagccguggccagagucaaccagaaucugccgaucaucgauaagacacugaaggcuuaucucggauggaccuuucuguucaccaugaagcaaaacgaguacuuuauuuucccuaacaagcagacaggcuuuaaucccaccgaaaucgaccuucuggauuccaugaacaauaaacucauuagcccuaaccuguuccgcgugcagaaguuuacagugaaagacuauuucuuucggcaucaccucgagacgaaugucgaagaugacucuaagcugaaaaacaccacauggaagagagaggggcuuggaggcaucgggaauauuguuaaagugcggaucaaccauauuggacagaucgugaagaucggcgaguacuga

SEQ ID NO: 4514 - RNA, 4305 nt, Artificial Sequence
  Cas9 variant
augaagaacauccugggccucgaccuggggaccaauagcauuggaugggccuacgugaaacaggcucaaaacgauuccgagaagucugaaaucgccgagcuuggcgucagaguuaauccccugacaguggacgaaaagacgaacuucgagaaggggaaaccuauuagcaccaaugcggaucggacacucaagcgcggagcuagacggaaccugcagcgcuauaaacuuagacggcaggaacugaucgagcuccugaaagacuaccaggugauuuccgauaagaccauccuggccgaggacggcaaagaaacaaccuuugagacacuccgccugagagucaagucugccaaagaacaagugagccuugaggagcuggcucggauccuccugaugauuaauaagaagcgcggguauaaauccucuagaaaggccaaaaacgaagaugagggacagcuuaucgacggcauggaaauugcucggcgccuguacgaugagaaucucaccacgggccagcugagccugcagcuccugaaggaagggaaaaagucccuuccggacuauuacagaagcgaucugcaacacgagcucgacaaaguuuggaacuuccagaagcaguuucaucccgauauccugaccgacgaguucuauacaucuauucagggaaagggccaaaaagccacccgggaauccuuuagcucuaaguacgggaucgacacagcggagaauaaaggaucccgcgaagagaagaaacuucaggccuaccaguggagagcugaugccacccacaaggaacugacgaaggaggagcucgcuuucgugauuacagaaaucaacaauaacaucaauaacagcucuggcuaucugggggccauuuccgaccggagcaaagagcugaucuuugcgaacgaaaccgucggagaguaccucuggaagcaaauucagaaugauccucauacaucccugaaaaaccagguguucuauagacaggacuacuuugaugaauuugagcgcaucugggagacccaaucuggcuuuuauccccagauucuuaccgaaagccugaagaaugagcuccgggacauccugaucuucuaccagagaaaacuuaagucccagaaggcccugguuagcauuugcgaauuugagucuaaagagaucccucucaaggauaaacaaggcaaccccauuuccaagaaugggaucccugugacaaaacuggucggaccgaagguggcucccaagagcucuccucuguuccaggaguucaaaauuuggcagaaccucaauaacgugcugguccgccccaagggcagccggaaaagaaagguuacgaccaaucagcaauccacacuucuggaagggcaggaaccuguguuugagcucaaccuggaacagaaagagcugcuuuucgaggaacucaaucugaagggaaaccugaaaaccgacuauugucucgagcugaucggcuacucugccaaggaaugggagaugaauuaccccacacuugaagggaacaagaccaauaaagcucuguaugaggccuaccucaagaucauugauagcgagggauaugacgccaaaaagcugcugaaagugaagacggauaaggacgacaucaaccuugaugacauuaaagucuccgcuagcgaaaucaagacaaugauuucugauaucuuuaacgagcucggcauuaauaccaaaauccuggacuucgaugcggaacuggagcgcaagcaguuugaagcccaggcuuccuaccggcucuggcaucugcuuuauagcuacgagggcgacgauucuaaauccgggaacgagcugcucuauagacugcuggaagacaaguucggauuuaagcgcgagcacagcaaaacccuugccaaugugucccuccugucugauuacggcaaccugagcacaaaggccauccggaccauuuacccguauaucaaagaaaauaaguucuccacagcuugcgagcucgccggguacagacacucuaaacugagcauuuccaaggaggaaaacgagaaucgcacgcuuaaggacacccuggauguucucaaaaagaacagccugcggcaaccuguggucgagaaaauccugaaucagaugauuaaccuuaucaaugaacucaucgaaaagcacucugagaaagacgagaagggaaacauugugaaauauuuuaaguucgaugaaauccauauugagcuggcgagagaacugaagaaaaaugcugaggaacggcgcgagcucgacuccaagguuagagagggcaaagaccggaacgaaaagaucauuacaauccugaaaagcgaguuugggcuucccuacccuaccaagaaugauaucacaagauaucgccuguacgaggaacucaaggacaacggcuauaaagaucuguacaccaacacguacauuccccgggaaaagcuguucucuaaagagaucgacauugagcacaucauucccaaguccagacuuuuuaaugauagcuucucuaacaaaaccaucuguuaucgccaagacaaucugaacaagggagaaagaacagccuacgauuauaucgagggccucgggaagacccagcuggacgaauaccucaaucggguggagaaccuguauacaaauaaauucauuaccaaggccaaauaccgcaaccuucugaagaaagagagcgaaaucggagauggcuuuauugagagagaccuccgggaaacgcaguauaucgcuaagaaggccaaagagaugcugcugcagauuacacgccaugucguguccaccacagggagcaucaccgauagacuucgggacgauugggaacuggucaaugugaugcgcgagcucaaccugccuaaguacaaaguucucggacugaccgagauucaagaaagaaagaauggccagacaguggaggucaucacggacuggaccaaacggaacgaccaccgccaccaugcuauggaugcccuuacaguggcguucaccaagcacucucauauccaguaccugaauuuucucaacgccagaaaggacgaaaaacacaaggaguauuccaauauuauggggauccagcaacuggaaacagagaaaaccacggauaaggacggcaaagaucggagaguuuucaagacaccgauucccaacuuucgccagguggcuaaagagcaucuggaaagcauccuuauuucccacaagaccaagaacaaagucgugacccgggccacaaauaagaucgcuggaucuaaaaagcagcaggagacccugagcccuagaggccaacuccacaaagaaacaguguacgggaaguaucgccgguacguucagaaggaggagaaaaucggauccaaguucgaccugcagacgauugaaagagucgccaacccccucuauaaacgccugcuuaccaagcggcuggaggaaaauggcggggauccuaaaaaggcguuuacaggaaagaacgcccuggcuaaaucucccaucuaccucgacgagacccaaacacagcagcugccggaaaaggugaaacuuguguggcuggagaccgauuucagcauuagaaaggacaucacgccugauaauuuuaaagacgagaaguccauugacaagguccucgaugaaggcaucaaacgcauccugaaggaccggcucaaaucuuucgauggggacgccaagagagcuuuuaccgaucuggagcagaaccccauuuggcuuaauaaagaaaagggcaucgccauuaaacgggugacaaucagcggaguuuccaacgccgagccucugcauaccaagaaggaccaccugggcaaugaaauuuucgaugacacagggaaacccaucccuguggauuaugucagcaccggaaacaaucaucacauugcuaucuaccgcgacgagaacggcaaucuccaagagaaggcggugucuuucuucgaagccguuacaagagcuaaccaggggcugcccaccguggauaaaacguacaaucagcaccuuggauggcaguuccuguuuacaaugaagcaaaacgagauguucgucuuuccgaauaaagaaaccggcuucgacccucaggagaucgaucuccuggaccccaagaacaagaaacucauuucccccaaccuguuucgggugcagaagaucagcaccaaaaauuauuucuuucgccaucaccuugaaacaucuguugagacccauaacgcccugaauggggugacguacaagucccagcugggccucaacggaauuacagacaucauuaaagucagaaucaaucaccugggcgauaucgugcauauuggggaguauuga

SEQ ID NO: 4515 - RNA, 4308 nt, Artificial Sequence
  Cas9 variant
augcugggcugcgagagaaagcggaaacgcagagaaaaggagaaaauggccaagcccaaagacuacaccaucgggcucgauauuggaacaaacagcgugggcugggucguuacggacgaucagaauaacauccugcggauuaaggggaagaaagcuaucggagcccgccuuuucaccgaaggcaagguggcggcugagagacgguccuuucgcacaaccagacggcgccugucuagacggcgcuggagaauuaaaaugcucgaagaacuguucgacgaggaaaucgccaagguggauccuagcuuuuucgcccggcuucacgaguccuggaucucuccgaaagacaagcgcaagagauauagcgcuauugucuuucccuccccugaagaggauaaaaaguuccaugagucuuaccccacaaucuaucaucugcgggacaaacucaugaaggaugaccaaaaacacgauauuagagaaaucuacauugccgugcaccagaugaucaaggcucgcgggaauuuucugcaugacgagagcguugaaaccuaucgguccggaaugagcucucugggcggcagauccgagcgcaacauucucagcgugcagacacuggaagaacuuaaugaucuguucgccgagaacgaagggaccgaggaagucgagcucaauguggcgucugccgaacagaucaacgacauccugacgggaggccaccuuaaugcugacucccaaaaagagauuagcaaccugcuccugccuucuuccuuucccagcuucgaugacaaggccaaggagaaacagguuaagaaacugaucaauaacguggcuaccaauauuuccaaggccuggcucggguacaaagcggauuuuucuacaauccugaaccuugccaaggucgacaaggaucagaaaaagauuuucgcuuuugcccugcagggaggcgacgaagaggauaaagugcaagaacucgagagccugcuugaacagucccagaccgacaucguggaucggcugaucgagauuagacacgcuaucguccucagcgagauuguuccuguggggaugacacugucugaagccaugaucgacaaguaugaucagcauaaagaggaccugauuacccucaaggccgugauccgcaauacgaaggacaaaaagaaagcugcgaagcugcaagccaucuacgaucuuuacgucaaaaaccggcacgcugaccuggccaaggccaugaagcucacaggaauuaaaaagagauccgaacugcuugauccggaggagcugaaaaagggcaucagcucucuccuggacgauagccccgaagcuguggagauuaaacagcgccuggaagagaagaccuuccucccucugcagcgguccaacaauaacggcguuauccccaaucaacuucaucagguggaacuggacgagauuaucaaaaagcagucuaaguauuacccuuuccucgccgagaaaaaccccgaugaaagcgaggaagcgcagaagaaagcuccgacaaagcuggacgcccugcuuaccuuuagagucccuuauuacguggggcccaugauuaccaaagaggaacaagaggcccagaauggacacuccuucgcuuggaugguucgccgggauccucaggaccacgaggccaucacacccuggaacuuugaaaagaagguggauaaaauggcuagcgccacgcaguucaucaagagaaugaccacaaaagacaccuaucuccugggcgaggauguccugcccgcgucuucccucaaguaccaacuguuuacagugcuuaaugaacugaacaaucuccgggucaacgggaaaaagcugaccagcgacgagaaggaacaggugauugagggacuguucaaaaagcagaaaacgguuaaggccgacaaauuugugaaguauuggcaggcuaagcauaucggcgccgauauuaaagucaaggggcuuucugacccuuccaaauucaauagcacaauguccaccuacaucgauuuuaagaaaauuuucggagaccaacucaacgaugugaaucgccagaacgacuuugagaagaucaucgaauacucuaccauuuucgaggauagaaaaauccuggaagacaagcugcggguugauuuugcuuggcucagcgaggagcagauuaagcagcuguguagacuucgccugcaaggcuggggccggcucuccgacaaacugcugacaagacuuaccgaugccgacgggcagaaugugcucgaacgccuguggaacucuaacgauaauuucguccagaucgugagcgacccgaacauuaaggcgaaaaucgagcaagaaaaucagaagcugcucagagacucccagagcgauaacgccguggagucuauccuggacgaugcuuauacaagcccccagaauaaaaaggccauucggcaaguuaugcgcgucgugcacgacaucgugaaggcuugcgauggaaacgucccugccaaauucgccauugaauuugcuagaucccaggaggacgaucccaagcggacgaccgcgcgcgugaaucagaugcagaaaaucuacgaccaaauuucugaugagguugugucccagggcgucaaggaacagcuuagcgggaugaaaucucugaaggacagauauuaccucuauuucaugcagggaggccgggaugccuacacaggggcuaagcugaacaucgaccgccugagcgacuaugauguggaccauaucaugccucaauccuuuguuaaagaugacagccuugauaauagagugcucgucgcccgggccgugaacaaucagaagucugacaaaguucccgcucugcuguucggcaacaagguggucgccgaucucggaauuaccgugcgcgagaugugggacaaauggcagaagcugggcaugaucuccaagagaaaacuuagcaaucugcucacagauuccgacgcgcugaccgaauaccgggcucaaggguuuauuagacgccagcugguggagacgucucaggucaucaaacuuaccgccacaauucugcagagcgaguucccggauuccaaaaucauugagguuccugccaaguacaacucuaucgugcggaaacaauuugaccucuauaagagcagagaggugaaugauuuccaccaugcuaucgacgccuaccuguccaccauugucggaaacuaucucuaccagguguaucccaaccugcgccggauguuuguuuacggcgaguucaagaaauuuucuagcaaugcggaggaauccgcucacgacguggccagacgcgucaagagcaugaacuuccuugaugaccugcuccgggggacacacggagauaauaucuauuguagaucuaccggcgagauuguguuuaaccgcaaugacaucauuuccaaacugaagcaggccuacagcuucaaacagaugcugguuacgcaagaaguguucacaaagaaaucugcucuuuuuaaccagaccgucuacccuucccccaagcgggaugggagcaagagaucuggccugaucccucggaaacgcggaauggaccccgagaucuauggcggguacgcccauaaucaggauuccuauuucgugcucgcuaagauugagaaaguuaagggauacacacugcagaucgugggcgucccgauuagaagccucgaaaucauuaacaaagccgaggacuuuuccaccgcgcugcuugauaucaucaagagcaaggugauguauaaugaaaagaccgggcaaccuaagcggggaauuaaaaacguggagauccuggucaauaagcuccccuaccgccagcccauucuggagaaagacguuucuuauaugcugggcagcuccgccuacaaguacaacaucaagcagauuacacuuucuagacagagcaugaaauauauccuggauuacauugacgauccuaauuucacgaagcacgaaaugaccaugaucgacgagcaaaacgaacgggagugccuccuguccguguaugacgaaauccucgagaaaguggauaaguaccugccgcuuuuugacgggaauaaauucagagagaagcugcauucugcucgcaaggaauuugucagccuguccguggaugacgaggccucugcuauugagaaaauccuccggggccugcacgccaacagcgaaaugcccucccuugaaaaccugaagauuaaaccugcccucggauucuuucagaugaagaauggcaucacacugagcaacgaugcuguucuccuguaucagucucccaccgggcuuuucgagagacgcgugaaagucuccgaccugcugaaguga

SEQ ID NO: 4516 - RNA, 4308 nt, Artificial Sequence
  Cas9 variant
augaagaacauccugggccucgaccuggggaccacaagcauuggauucgcccacaucguggaggaugaaaauaaagagaaguccgaaauuaaagagcuuggcgucagaaucguuccccugacgaccgacgaacagucugauuuugagaaggggaaaagcauuacaaccaacgcuaaucggacacucaagcauggagcccgccugaaccuugacagauaccaacagcggcgcaaguaucugaucgaucuccugcagaaagcgaaucugaucaccuccucuagcauucucgcugagaacggcaagaauacaacccacuccacguggcagcugagagccaaagccgugaccgaacggaucgagaaggaagaguucgcucgcgugcuucuggccauuaacaaaaagagaggguacaagucuagccggaaagcuaagacagaggacgaaggacaagccaucgauggcauggcgauugccaaacgccucuaugacgagaaucugaccacaggccagcuuucccugcagcuccugcagcaaaacaagaaacugcucccugauuuuuacagaagcgaccugcagaaggaauuugaucuugucuggaauuuucagaaacaguucuauccggacauccugaccgauucuuuuuacaaggagcuccaagggaagggaaaagacgcuacguccaaggccuucagcaaacgguaucauuuugacacagcugaaaacaagggcucuaaagaguccgugcgccugcaggccuaccaguggagaguugaggcgauuagcaagcaacuuucuaaggaagagguggccuacguccugaccgaaaucaauaacaaucucaacaacgcuuccggguaucugggagccaucagcgaucgguccaaagagcuguacuucaaucgccagacagugggccaguaucucuacgcucagcugcaagaaaacagacacaauucucuuaagaacaaaguuuucuaucggcaggacuaccuggaugaguucgagagaauuugggaaacccaggccagcuuucauaaggagcucaccgaggaacugaaaaagcagauccgcgacguggucauuuucuaucaacggaagcccaaaucccagaaggggcuuaucagcuucugcgaauuugagucuaaagagauugaaaucgagaaggauggaaaaacaaucacgaagaccauuggcgccagaguggugccuaaguccagcccccuguuccaggaauuuaaaaucuggcagauucucaauaacgucaucuguaagcgcaaaggcauucggaagaaaaagguuucugcuaaaacaacccaacuggaccugcucaaugagagcucccagacaaucuucucucuggauauggagugcaagcagcuucuguuugaggaacucaaccugaagggggaccugaaaagcgauaaggugcuuaaacuccugggauacuccccucaggaaugggagaucaauuacaaccaacuggaaggcaauagaacccagaaggcgcucuaugaggccuaccugaaaauuguggagauggaagcucacgacgucaaggauauccuucagauuaagagcgccaaagacgacuggucucuggaugagagcccccucuccgccucugaaauccgcgaguccgugaaggcuauuuuccaagcccuggggaucuguacgaaaauucuguauuuugacccucuucucccgguuaaggaguucgaaaaacaggauagcuaccagcuguggcaucugcucuauuccuacgagucugacgauagcacauccggaaacgaaacccuguaucggauccuugagaagaaguacgcguuuaaaagagaacacgugcgcauccuggcuaaugucgcccuccaggacgauuacggcucucugagcaccaaggccauucggaaaaucuaucccaacauuaaggagaaucaauacuccaucgcuugcgaaauggccggguauaaacacagcaagcugucucuuacaaccgaggagcucgaagcuagagagcugaagaacauuaucccucugcucaaaaagaacgcccugcgcaaucccgugguugaaaagauccuuaaccagaugauuaauguggucaacgcgcugaucgagaaaaauuccgagcgggacgccgaaggaaaaauuacaaaguacuuccauuuugaugagaucagaauugaacucgcucgggagcugaaaaagaacgcccagaagcgcuaugaaaugacgcagaauaucaacaaagcuaagcuggagcaccagaaaaucagcgagauucuucaaaagcaguucggcaucaaaaauccuaccaagucugacauuaucagauaccggcucuaucaggaacuggagcacaacggcuacaaggaacuguacacaaaugccuauauugcgcccgaugugcucuuuuccaaaaacaucgacaucgagcauauugucccgaaggccagaguguucgaugacagcuucucuaauaaaacccuggcuuuucgcgaguucaacaucaagaaaggggaaagcacagccuuugacuacauuaccucccuuaauagcgaggaggaacugaaccaauaucucacgcggguugaaaacgcuuacaagaccaagucuaucuccccuacaaaauauaagaaucugcugaaaaaggccagcgagauuggagaugacuucaucaacagagaucuucgcgacacccaguacauugccaaaaaggcuaaggaaauccuguuucaggugaccaaaaauguccucuccacaucuggcagcaucacggauagacugcgggaggacugggggcucguggauguuaugaaggagcugaacaugcccaaauaucaaucccuuggacugacagaaguggaggaacgcaaggacggcaauaaagucaccgugauuaagaacuggacaaagagaaaugaucaccggcaucacgcgauggacgcccucaccguggcuuucaccaaaccuucuuacauccaguaccugaaccaucugaaugcccgcaaggaugagaacaauaaaaacuauagcguuauucuugccaucgaggaaaaggagacaauuaaagucagaacgaauaacgggaagaauaaacggguguuuaucgaacccauccccaacuuccgccagguggcuaagaagcaccuggaggaaauuuuuaucucccacaaaaccaagaacaaagucgugacaaagaauguuaacaaaccugccggcaccgacaagcagcaaauuacacucaccccgagaggacagcugcauaaggagacgaucuacggcaaauaucaguacuaugugaauaaggaggagaaaauuggggucaaguucgauaaagaaacaaucgcgaaggugucuaacccccucuaccgggaagcucugcuuaagcgccugcaggccaaugacaacgacccuaaaaaggccuuuaccgggaaaaaugcucucagcaagaaacccaucuaucuggaugaguccaagaccaagacacugccugaaaaaguuaaccuuaccuaccuggaggaggacuucagcauuagaaaggauaucucucccgacaauuuuaaagaucucaaguccauugaaaaagugaucgaccaaggcgucaagcggauucugaucaaaagacuccaggccuacgauaacgacccgaagaaggcguucguggaucuggagaaaaauccuauuuggcuuaacaaggaaaaagggaucgcuaucaagcgcguuacaauuagcggagugaauaacgcccagccccugcacaucggcaaagaccaucuggggaagacgacccucaauaaggagggcaaagaaauuccugucgauuaugugucuacaggaaacaaucaccacguggccaucuaccgggacaaggagggcaaccugcaggagcaaauugucuccuucuuugacgcuguugugagagcccagcaggggcuucccaucaucgauaaaaccuauaagcaggcugaaggauggcaauucauguuuacaaugaaacagaacgagauguucguguuuccuaaugaaaccacgggcuucaaccccgccgagauugaccugcucgauccgaagaauaagaaacugaucagcccuaaccucuuucgcguccagaccauuucugugguuaaguacggaaauuccgugguccgggacuucaaauuuagacaucaccuggagacaacccuucaagaugacaagauccugcagggaauuacauuccagcagaucaaaagccuggaaccccuccgcaacaucgugaagguucggauuaaucaucugggcgauaucguguccauuggggaguauuga

SEQ ID NO: 4517 - RNA, 4308 nt, Artificial Sequence
  Cas9 variant
augaagaacauccugggccucgaccuggggaccacaagcauuggauucgcccacaucguggaggaugaaaauaaagagaaguccgaaauuaaagagcuuggcgucagaaucguuucucuggcuacggacgaacagagcgauuuugagaaggggaaauccauuucuaccaacgccaaucggacacucaagcauggagcgcgccugaaccuugacagauaccaacagcggcgcaaguuccugaucgaucuccugcagaaagcuaaucugaucaccagcgccuccauucucgccgagaacggcaagaauacaacccacucuacauggcagcugagagcuaaagccgugaccgaacggaucgagaaggaagaguuugcucgcgugcuucuggccauuaacaaaaagagaggguauaagaauagccggaaaacgaagaccgaggacgaaggacaagcgaucgauggcauggccauugcuaaaugccucuacgacgagaaccugacacccggccagcuuucccugcagcuccugcagcaaaauaagaaacugcucccugauuucuaucgcagcgaccugcagaaggaauuugaucuugucuggaaccugcagaaacaguucuacccggacauccucaccgauucuuuuuauaaggagcugcaagggaagggaaaagacgccacauccaaggcuuucagcaaaagauaccauuuugacaccgccgaaaauaagggcucuaaagaguccgugcggcuucaggcguaucaguggcgcgccgaggcuauuagcaagcaacugucuaaggaagagguugccuacgugcucacggaaaucaacaauaaccugaacaauuccagcggguaccugggagcuaucuccgauagaucuaaagagcucuauuucaaccggcagacagucggccaguaccuguaugcccagcuucaagaaaaucgccacaacagccugaagaauaaaguguuuuacagacaggacuaucucgaugaguucgagcggauuugggaaacccaggccuccuuucauaaggagcugacagacgaacuuaaaaagcagaucagagauguugugauuuucuaccaacgcaagcugaaaagccagaaggggcucgucucuuucugugaguuugaauccaaagagaucgagauugaaaaggacggaaaagcuaucaccaagagcaucggcgcgcggguggugcccaagucuagcccucuguuccaggaguuuaaaauuuggcagauccugaacaaugucacaugcaagagaaaaggcauucgcaagaaaaaguccucugccaaaagcacagaacucgaucuguucaacgagcccucccaaagcaucuuuucucuugacauggaguguaagcagcuccuguucgaugaacugaaucugaagggggaccuuaaauccgauaagguucucaaacugcugggauauagcccucaggagugggaaauuaacuacaaucagcucgagggcaaccggacgcaaaagucucuguacgaggcuuaucuuaaaaucaucgaaauugagggguacgaagugaaggacauccugcagauuaaguccaccaaagacgauuggagccucgacgagucuccccuguccgccagcgaaaucagagagcgcgugaaggucauuuuucagacacugggaaucugcaccaaaauucuuuauuucgauccucuccugccggugaaggaauuugagcaacaguacuccuaucagcuguggcaccuccuguacucuuaugagagcgacgauuccacaagcggcaaugaaacccuuuaccggauccuggagaaaaaguacgccuucaagagagaacacgcuacgauccucgccaacguugcgcugcaggacgauuaugggucucuguccacaaaagcuauucgcaagaucuaccccuauauuaaagagaaucaauacagcaccgccugugaacuugccggauauaagcauucuaaacucucccugaccacagaggagcuggaagcucgggagcucaagaacaucauuccucugcuuaagaaaaacgcccugagaaaucccguggucgaaaagauccucaaccagaugaucaaugugguuaacgcucugauugagaaaaauagcgagcgcgacgccgaaggcaagaucaccaaauacuuucacuucgaugagauucggaucgaacuggcgagagagcuuaagaaaaacgcccaggaacgguaugagaugacacagaauauuaacaaggcuaagcucgagcaucagaaaaucucugaaaagcugcaaaaacaguuuggcaucaagaauccuacgaaaagcgacauuauccgcuacagacuguaccaggagcucgaacacaacggguauaaggagcuguacaccaauacauauauugcccccgaugugcuuuucuccaagaacaucgacauugaacacaucgucccgaaagcucggguguucgaugacagcuuuucuaauaagacccuggccuucaaagaguuuaacaucaagaaaggagaguccacagcguucgacuacauuaccagccucaauugcgaaggcgagcugaaccaauaucugacgagagucgaaaacgccuacaagaccaaguccaucucucuuacaaaauauaagaaucugcucaaaaaggcuagcgagauuggggauggauuuaucaaccgcgaccugcgggauacccaguacauugccaaaaaggcuaaggaaauccucuuccaggugaccaaaaauguucuguccaccucuggcagcauuacggacagacuucgcgaggauugggggcugguggacgucaugaaggagcucaacaugccuaaauaccaaucccugggccugacagaaguggaggaaagaaaggauggaaauaaaguuaccgugaucaaggacuggacaaagcggaacgaucaucgccaccaugccauggacgcccuuaccgucgcuuuuaccaaacccucuuauauccaguaccugaaucaccucaacgcgagaaaggaugagaauaacaaaaauuauagcgugauucuggccaucgagaagaaagaaacaauuaaggugccuaucaacaauggcaaaaacaagcggguuuucauugagcccauccucaauuuucgccaggucgcuaagaaacaucuggaagagaucuucauuucccacaaggccaaaaacaagguggugacgaaaaacaucaauaagcccgccgggaccgacaagcagcaaauuacacuuaccccuagaggacagcugcacaaagaaacaaucuacggcaaguaucaguacuaugucaacaaagaggagaagguggggguuaaauuugaugaacggaccauuacgaaggugagcaauccgcucuaccgcgaggcucugcugaagagacuucaggccaacgacaaugaccccaaaaaggcguucgcuggcaaaaacgcccugucuaagaauccuaucuaccucgaugaagccaaaacaaagacccugcccgagaaggucaaccucaccuaucuggaagaggacuuuuccauccggaaagauauuagcccugacaauuucaaggaucuuaaaucuaucgagaaggugauugaccaaggaguuaaacgcauccugauuaagagacugcaggcuuacgauaacgaccccaaaaaggccuucguggaucucgaaaagaauccgaucuggcugaacaaagagaaggggauugcgaucaaacgggucacaaucuccggcgugagcaaugcucagccucuucauauuggaaaggaccaccugggcaaaaccacacucaacaaggaagggaaggagguucccguggauuaugucucuacgggaaauaaccaucacguggccaucuacagagacaaagaaggcaaucugcaggagcaaauuguguccuuuuucgaggccgucguucgcgcucagcaggggcucccuaucauugacaagaacuauaaacaggccgaaggauggcaauuuauguucaccaugaagcagaacgagauguuuguguuccccaaugaagcuacaggcuuuaacccugccgagaucgaucugcuugaccccaaaaauaagaagcugaucagcccgaaccuguuccgggugcagaccauuuccaucgucaaauacgggaauagcgugguuagagauuuuaaguuccgccaccaucucgagacaacccugcaagacgauaaaauucuucagggcaucacguuucagcagauuaagucucuggaaccucuccggaacaucgugaaagucagaaucaaucaccugggagacauugugaacaucggcgaguauuga

SEQ ID NO: 4518 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagaacuacacagaguggaauaaagaaaaggggaaaaccgagcagcaagaacgcgagcauaagcucgaaggaaucuacagcaaacggaagagagaugaggccaagcgcgagaaccugcaguggcgggugaacggccugaaagaaaagcucucccuggagcagcuugucauuguguuccaggaaaugaauacacaaaucaacaauagcucuggguaucugggagcuaucuccgacagaagcaaagagcucuacuuuaacaagcagaccgugggccaguaucagauggagaugcuggacaaaaauccuaacgccucucuucgcaauauggucuucuaccggcaagauuaucuggacgaauuuaacaugcucugggagaagcaggcuguuuaccacaaggaacugaccgaggaacugaaaaaggagauuagagauaucauuaucuucuaucagcgccggcucaaaucccaaaagggccugauuggguuuugcgaguucgaaagcagacagaucgagguggacaucgauggcaaaaagaagauuaaaacagugggaaaucgcgucaucucucgguccagcccccuuuuucaggaguucaagauuuggcagauccugaacaauauugaagugacgguuguggggaaaaagagaaaacggcgcaagcucaaagaaaacuacuccgcccuguucgaggagcugaaugacgcggaacaacuugagcucaacggaucuagacggcugugucaggaagagaaggaacugcucgcccaggagcuguuugucagagauaagaugaccaaaagcgaggugcuuaagcuccuguucgacaauccucaggaacuggaucugaacuuuaaaacaaucgacggcaacaagaccggguacgcucuuuuccaagccuauuccaaaaugaucgagaugagcggacaugaacccguugauuuuaagaagccuguggagaaagucguggaguacauuaaggcugucuucgaccuccugaauuggaacacagacauccugggcuuuaauucuaacgaggaacucgauaaucaguccuauuacaaacuguggcaccuucuguauagcuucgaaggcgacaacaccccgacggggaauggacgccucauucagaagaugacagagcuguacggcuuugaaaaagaguaugccaccauccuggccaacgugucuuuccaggaugacuacgggagccuuuccgcuaaggcgauucauaagauccucccccaccugaaagagggaaaucgguacgauguugccugcguguaugcuggcuacagacacucugaaagcucccugacccgcgaggaaauugccaacaagguccucaaagacagacugaugcuucugccuaagaauagccuccauaaccccgugguugagaaaauccugaaucaaauggugaacgucaucaaugugauuaucgauauuuaugggaagccugacgaaauccggguggagcuggcccgcgagcuuaagaaaaacgcuaaggaaagagaggaacucacaaaaucuauugcccagaccacaaaggcgcacgaggaauacaaaacgcugcugcagaccgaguuuggccucacaaacguuucccggaccgauauccugcgcuauaaacuuuacaaagagcuggaaagcuguggauauaagacacucuacucuaauaccuacaucuccagagagaagcuguucagcaaagaauuugacauugagcauaucauuccccaggcucggcuguucgaugacuccuucucuaacaagacgcuugaggcccgcagcgucaauaucgaaaaaggcaacaauaccgccuaugauuuugugaaggagaaauucggggaauccggagcugacaacucucuggagcaauaccucaauaacauugaagaccuguuuaagagcggcaagaucuccaaaacaaaguauaauaaacucaagauggccgagcaggauaucccggacggguucauugagagagaucugcggaacacccaguacaucgcuaaaaaggcccuuagcaugcugaaugaaauuucucaccgcguggucgcgacauccggaagcgugaccgacaagcucagagaggauuggcaacugaucgacguuaugaaagaacugaacugggagaaguauaaagcccuuggccugguggaauacuuugaggaucgggacgggagacagauuggccgcaucaaggauuggacgaaacggaaugaccacagacaucacgcuauggaugcccucacagucgcuuucaccaaggacguguuuauccaguauuucaacaauaagaacgccucucuggauccuaacgcgaaugagcaugccauuaaaaacaaguacuuucagaauggacgcgcuaucgcccccaugccucuccgggaguucagagcugaagccaaaaagcaccuggaaaacacacuuauuuccaucaaagccaagaauaagguuauuaccggcaacaucaauaaaacccgcaagaaagggggagugaacaagaauaugcaacagacaccccggggccagcugcaucucgagacgauuuacgggagcggaaaacaguaucugaccaaggaagagaaagucaacgcuucuuuugacaugagaaagaucggcacagugagcaaguccgcguaccgcgacgcccugcuuaaacggcuguaugagaaugauaacgaccccaagaaggcuuucgccgggaagaauagccucgauaaacaaccuaucuggcuggacaaggaacagaugagaaagguuccggagaaagugaagauugucacccucgaagccaucuacacaauucggaaagagaucucucccgaucugaagguggacaaagugauugaugucggcguucgcaagauccuuaucgacagacugaacgaguauggaaaugaugcuaagaaagccuuuuccaaccuggacgaaaauccuauuuggcucaacaaggagaaaggcaucagcauuaagcgggugaccaucuccgggauuucuaacgcgcagagccugcacgugaaaaaggauaaggacggaaaacccauccuugacgaaaauggccgcaacaucccugucgauuucgugaauacggggaacaaucaccauguugcuguguacuauagacccgucauugacaagcggggacagcuggugguugaugaggccggcaacccgaaauacgaacucgaggagguggucguguccuucuuugaagccguuacaagagcuaaucuggggcaaccuaucauugacaaggauuacaaaaccaccgagggcuggcaguuccucuuuucuaugaagcagaacgaauauuucguguuucccaaugagaaaacaggauucaacccuaaggaaaucgaccugcuugaugucgagaauuacggccugauuagccccaaccuguuucgcgugcaaaaguucucccucaaaaauuauguguuucggcaccaucuggagaccacaaucaaggacacgucuagcauucuuagagggaucaccuggaucgauuuccgcuccagcaaaggacuggacacaauugucaagguucgggugaaccacaucggccagauugugucugucggggaauacuga

SEQ ID NO: 4519 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagaacuacacagaguggaauaaagaaaaggggaaaaccgagcagcaagaacgcgagcauaagcucgaaggaaucuacagcaaacggaagagagaugaggccaagcgcgagaaccugcaguggcgggugaacggccugaaagaaaagcucucccuggagcagcuugucauuguguuccaggaaaugaauacacaaaucaacaauagcucuggguaucugggagcuaucuccgacagaagcaaagagcucuacuuuaacaagcagaccgugggccaguaucagauggagaugcuggacaaaaauccuaacgccucucuucgcaauauggucuucuaccggcaagauuaucuggacgaauuuaacaugcucugggagaagcaggcuguuuaccacaaggaacugaccgaggaacugaaaaaggagauuagagauaucauuaucuucuaucagcgccggcucaaaucccaaaagggccugauuggguuuugcgaguucgaaagcagacagaucgagguggacaucgaugggaaaaagaagauuaaaacagugggcaaucgcgucaucucucgguccagcccccuuuuucaggaguucaagauuuggcagauccugaacaauauugaagugacgguuguggggaaaaagagaaaacggcgcaagcucaaagaaaacuacuccgcccuguucgaggagcugaaugacgcggaacaacuugagcucaacggaucuagacggcugugucaggaagagaaggaacugcucgcccaggagcuguuuaucagagauaagaugaccaaaagcgagguccuuaagcugcuuuucgacaauccucaggaacuggaucugaacuuuaaaacaaucgacggcaacaagaccggguacgcucuuuuccaagccuauuccaaaaugauugagaugagcggacaugaacccguggauuuuaagaagccuguugagaaaguggucgaguacaucaaggcuguguucgaccuccugaauuggaacacagacauucugggcuuuaauucuaacgaggaacucgauaaucagccguauuacaaacuguggcaccuucuguauuccuucgaaggcgacaacacccccacggggaauggacgccucauccagaagaugacagagcuguacggcuuugaaaaagaguaugccaccauucuggccaacgucagcuuccaggaugacuacgggucucuuagcgcuaaggcgauccauaagauucucccucaccugaaagagggaaaucgguacgauguggccugcguuuaugcuggcuacagacacuccgaaucuagccugacccgcgaggaaaucgccaacaaggugcucaaagacagacugaugcuucugcccaaaaauucccuccauaacccugucguggagaagauccugaaucaaaugguuaacgugauuaaugucaucauugauaucuaugggaagcccgacgaaauucggguggagcuggcccgcgagcuuaagaaaaacgcuaaggaaagagaggaacucacaaaaagcaucgcccagaccacaaaggcgcacgaggaauacaaaacgcugcugcagaccgaguuuggccucacaaacgugucucggaccgauauccugcgcuauaagcucuacaaagagcuggaauccuguggauauaagacacucuacagcaauaccuacauuucuagagagaagcuguucuccaaagaauuugacaucgagcauauuaucccgcaggcucggcuguucgaugacagcuucuccaacaagacgcuugaggcccgcucuguuaauauugaaaaaggcaacaagaccgccuaugauuuugucaaagagaaguucggggaaagcggagcugacaauucccuggagcacuaccucaacaauaucgaagaccuguuuaagucuggcaaaaucagcaagacaaaauauaacaagcucaaaauggccgagcaagauauuccugacggguucaucgagagagaucugcggaauacccaguacauugcuaagaaggcccuuuccaugcugaacgaaaucagccaccgcgugguggcgacaucuggauccgucaccgacaaacucagagaggauuggcagcugauugacgugaugaaggaacugaauugggagaaauauaaggcccuuggccugguugaauacuuugaggaucgggacgggagacaaaucggccgcaucaaagauuggacgaagcggaacgaccauagacaccaugcuauggaugcccucacaguggcuuucaccaaggacgucuuuauucaguauuucaauaacaaaaaugccagccuggaucccaacgcgaacgagcacgccaucaagaauaaauacuuucagaacggacgcgcuauugccccuaugccccuccgggaguucagagcugaagccaagaaacaucuggaaaauacacuuaucucuauuaaggccaagaacaaagugaucaccggcaauauuaacaagacccgcaaaaagggaggaguuaauaaaaacaugcagcaaacaccccggggccagcugcaccucgagacgaucuacggguccggaaagcaguaucugaccaaagaagagaaggugaaugcuagcuuugacaugagaaagaucggcacagucucuaaaagcgcguaccgcgacgcccugcuuaagcggcuguaugagaacgauaaugacccuaaaaaggcuuucgccgggaaaaacucccucgauaagcagccgauuuggcuggacaaggaacaaaugagaaaagugcccgagaagguuaaaaucgugacccucgaagccauuuacacaauccggaaggagauuagcccugaucugaaagucgacaaggugaucgaugugggcguccgcaagauccuuauugacagacugaaugaguauggaaacgaugcuaaaaaggccuuuucuaaucuggacaaaaaccccaucuggcucaauaaggaaaaaggcauuuccaucaagcggguuaccauuagcgggaucuccaacgcgcagucucugcacgugaagaaagauaaggacggaaaaccuauccuugacgagaacggccgcaauauucccguggauuucgucaacacggggaauaaccaucacguggcuguuuacuauagaccggugaucgacaagcggggacagcuggucguggaugaagccggcaauccuaaauacgagcucgaagagguuguggucagcuucuuugaggccgugacaagagcuaaccuggggcuccccauuaucgacaaggauuacaaaaccaccgaaggcuggcaguuccuguuuuccaugaagcaaaaugaguauuucguuuuuccuaacgaaaagacaggauucaaucccaaagagauugaccuucuggauguggaaaacuacggccugaucucuccuaaucucuuucgcguccagaaguucagccugaaaaacuauguguuucggcaucaccuugagaccacaauuaaggacacguccucuauccugagagggaucaccuggauugauuuccgcagcuccaaaggacucgacacaaucgugaagguccggguuaaucacauuggccagaucgugagcgugggggaguacuga

SEQ ID NO: 4520 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagaacuacacagaguggaauaaagaaaaggggaaaaccgagcagcaagaacgcgagcauaagcucgaaggaaucuacagcaaacggaagagagaugaggccaagcgcgagaaccugcaguggcgggugaacggccugaaagaaaagcucucccuggagcagcuugucauuguguuccaggaaaugaauacacaaaucaacaauagcucuggguaucugggagcuaucuccgacagaagcaaagagcucuacuuuaacaagcagaccgugggccaguaucagauggagaugcuggacaaaaauccuaacgccucucuucgcaauauggucuucuaccggcaagauuaucuggacgaauuuaacaugcucugggagaagcaggcuguuuaccacaaggaacugaccgaggaacugaaaaaggagauuagagauaucauuaucuucuaucagcgccggcucaaaucccaaaagggccugauuggguuuugcgaguucgaaagcagacagaucgagguggacaucgaugggaaaaagaagauuaaaacagugggcaaucgcgucaucucucgguccagcccccuuuuucaggaguucaagauuuggcagauccugaacaauauugaagugacgguuguggggaaaaagagaaaacggcgcaagcucaaagaaaacuacuccgcccuguucgaggagcugaaugacgcggaacaacuugagcucaacggaucuagacggcugugucaggaagagaaggaacugcucgcccaggagcuguuuaucagagauaagaugaccaaaagcgagguccuuaagcugcuuuucgacaauccucaggaacuggaucugaacuuuaaaacaaucgacggcaacaagaccggguacgcucuuuuccaagccuauuccaaaaugauugagaugagcggacaugaacccguggauuuuaagaagccuguugagaaaguggucgaguacaucaaggcuguguucgaccuccugaauuggaacacagacauucugggcuuuaauucuaacgaggaacucgauaaucaguccuauuacaaacuguggcaccuucuguauagcuucgaaggcgacaacaccccgacggggaauggacgccucauccagaagaugacagagcuguacggcuuugaaaaagaguaugccaccauucuggccaacgucucuuuccaggaugacuacgggagccuuuccgcuaaggcgauccauaagauucucccccaccugaaagagggaaaucgguacgauguggccugcguuuaugcuggcuacagacacucugaaagcucccugacccgcgaggaaaucgccaacaaggugcucaaagacagacugaugcuucugccuaagaauagccuccauaaccccgucguggagaaaauccugaaucaaaugguuaacgugauuaaugucaucauugauaucuaugggaagccugacgaaauucggguggagcuggcccgcgagcuuaagaaaaacgcuaaggaaagagaggaacucacaaaaucuaucgcccagaccacaaaggcgcacgaggaauacaaaacgcugcugcagaccgaguuuggccucacaaacgugucccggaccgauauccugcgcuauaagcucuacaaagagcuggaaagcuguggauauaagacacucuacucuaauaccuacauuuccagagagaagcuguucagcaaagaauuugacaucgagcauauuaucccccaggcucggcuguucgaugacuccuucucuaacaagacgcuugaggcccgcagcguuaauauugaaaaaggcaacaagaccgccuaugauuuugucaaagagaaguucggggaauccggagcugacaauucucuggagcacuaccucaacaauaucgaagaccuguuuaagagcggcaaaaucuccaagacaaaauauaacaagcucaaaauggccgagcaagauauuccggacggguucaucgagagagaucugcggaauacccaguacauugcuaagaaggcccuuagcaugcugaacgaaaucucucaccgcgugguggcgacauccggaagcgucaccgacaaacucagagaggauuggcagcugauugacgugaugaaggaacugaauugggagaaauauaaggcccuuggccugguugaauacuuugaggaucgggacgggagacaaaucggccgcaucaaagauuggacgaagcggaacgaccauagacaccaugcuauggaugcccucacaguggcuuucaccaaggacgucuuuauucaguauuucaauaacaaaaaugccucucuggauccuaacgcgaacgagcacgccaucaagaauaaauacuuucagaacggacgcgcuauugcccccaugccucuccgggaguucagagcugaagccaagaaacaucuggaaaauacacuuaucuccauuaaggccaagaacaaagugaucaccggcaauauuaacaagacccgcaaaaagggaggaguuaauaaaaacaugcagcaaacaccccggggccagcugcaccucgagacgaucuacgggagcggaaagcaguaucugaccaaagaagagaaggugaaugcuucuuuugacaugagaaagaucggcacagucagcaaacuggcguaccgcgacgcccuucugaagcggcucuaugagaacgauaaugaccccaaaaaggcuuucgccgggaaaaacucccuggauaagcagccuauuuggcucgacaaggaacaaaugagaaaagugccggagaagguuaaaaucgugacccuggaagccauuuacacaauccggaaggagauuagccccgaucuuaaagucgacaaggugaucgaugugggcguccgcaagauccugauugacagacugaaugaguauggaaacgaugcuaaaaaggccuuuucuaaucucgacgaaaacccuaucuggcugaauaaagagaagggcauuuccaucaaacggguuaccauuagcgggaucuccaacgcgcagucucuucacgugaagaaggauaaagacggaaagcccauccuggacgaaaacggccgcaauauuccuguggauuucgucaacacggggaauaaccaucacguggcuguuuacuauagacccgugaucgacaaacggggacagcucgucguggaugaggccggcaauccgaaguacgaacuggaggagguuguggucagcuucuuugaagccgugacaagagcuaaccucgggcagccuauuaucgacaaagauuacaagaccaccgagggcuggcaauuccuguuuuccaugaaacagaaugaauauuucguuuuucccaacgagaagacaggauucaauccuaaggaaauugaccuucuggauguggagaacuacggccugaucucucccaaucucuuucgcguccagaaauucagccugaagaacuauguguuucggcaucaccuugagaccacaauuaaagacacguccucuauccugagagggaucaccuggauugauuuccgcagcuccaagggacucgacacaaucgugaaaguccggguuaaucacauuggccaaaucgugagcgugggggaauacuga

SEQ ID NO: 4521 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccggaaagaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagacauacaccgaguggaacaaagaaaaggggaaaacagagcagcaagaacgcgagcauaagcucgaaggaaucuacagcaaacggaagagagaugaggccaagcgcgagaaucugcaguggcgggugaacggccugaaagaaaagcucucccuggagcagcuugucauuguguuccaggaaaugaacacccaaaucaauaacagcucuggguaucugggagcuaucuccgacagaagcaaagagcucuacuuuaauaagcagaccgugggccaguaucagauggagaugcuggacaaaaacccuaaugccucucuucgcaacauggucuucuaccggcaagauuaucuggacgaauuuaauaugcucugggagaagcaggcuguuuaccacaaggaacugacagaggaacugaaaaaggagauuagagauaucauuaucuucuaucagcgccggcucaaaucccaaaagggccugauuggguuuugcgaguucgaaagcagacagaucgagguggacaucgaugggaaaaagaagauuaaaacggugggcaaccgcgucaucucucgguccagcccccuuuuucaggaguucaagauuuggcagauccugaauaacauugaggugaccguuguggggaaaaagagaaaacggcgcaagcucaaagaaaauuacuccgccaucuucgaggagcugaacgacgcggaacaacuggagcuuaauggaucuagacggcucugucaggaagagaaggaacugcuggcccaggagcucuuugucagagauaagaugacaaaaagcgaggugcugaagcugcuguucgacaacccucaggaacucgaucugaauuuuaaaaccaucgacggcaacaagacaggguacgcucuguuccaagccuauuccaaaaugauugagaugagcggacaugaacccguugauuuuaagaagccuguggagaaagucguggaguacaucaaggcugucuucgaccuucucaacuggaauaccgacauucugggcuuuaacucuaaugaagaacuggauaaccaguccuauuacaaacucuggcaccuucuuuauagcuucgaaggcgacaauacgccgacagggaacggacgccugauccagaagaugaccgagcucuacggcuuugaaaaagaguaugccaccauucuggccaaugugucuuuccaggaugacuacgggagccuguccgcuaaggcgauccauaagauucuuccccaccucaaagagggaaaccgguacgauguugccugcguguaugcuggcuacagacacucugaaagcucccugacacgcgaggaaaucgccaauaagguccugaaagacagacucaugcugcuuccuaagaacagccugcauaaucccgugguugagaaaauccucaaccaaauggugaaugucauuaacgugaucauugauaucuaugggaagccugacgaaauucggguggagcuggcccgcgagcugaagaaaaaugcuaaggaaagagaggaacuuaccaaaucuaucgcccagacaacgaaggcgaacgaggaauacaaaacccuccugcagacagaguuuggccugaccaacguuucccggacagauauccuccgcuauaagcuguacaaagagcuugaaagcuguggauauaagacccuguacucuaauacguacauuuccagagagaaacucuucagcaaagaauuugacaucgagcacauuaucccccaggcucggcuguucgaugacuccuucucuaacaagacccuggaggcccgcagcgucaauauugaaaaaggcaacaagacagccuaugauuuugugaaagagaaguucggggaauccggagcugacaauucucuugagcauuaccugaacaauaucgaagaccucuuuaagagcggcaaaaucuccaagaccaaauauaacaagcugaaaauggccaagcaagauauuccggacggguucaucgagagagaucuccggaauacacaguacauugcuaagaaagcccugagcaugcuuaacgagaucucucaccgcguggucgcgaccuccggaagcgugacggacaagcugagagaagauuggcagcucauugacguuaugaaagagcugaauugggaaaaguauaaagcccugggccuuguggaguacuuugaagaucgggacgggagacaaaucggccgcaucaaggauuggacaaagcggaacgaccacagacaucacgcuauggaugcccugaccgucgcuuucacaaaagacguguuuauucaguauuucaauaacaagaaugccucucucgauccuaacgcgaacgagcaugccaucaaaaauaaguacuuucagaacggacgcgcuauugcccccaugccucugcgggaguucagagcugaagccaaaaagcaccucgagaauacccugaucuccauuaaggccaaaaacaagguuaucaccggcaauauuaacaaaacacgcaagaaagggggagugaauaagaacaugcagcaaacgccccggggccagcuucaucuggaaaccaucuacgggagcggaaaacaguaucucacaaaggaggaaagagucaaugcuucuuuugacaugcgcaagaucgagaccgugagcaaauccgcguaccgggacgcccugcugaagagacuuuaugagaacgauaaugaccccaaaaaggcuuucgccggcaaaaacagccuggauaagcagccuauuuggcucgacaaggaacaaaaacggaagguuccggagaaagugaagaucgucacacuggaagccauuuacaccauccgcaaagagauuucucccgaucucaagguggacaaggugaucgaugucgggguuagaaaaauccugauugaccggcuuaaugaguauggcaacgaugcuaagaaagccuuuuccaaucuggacgaaaacccuaucuggcugaauaaggagaaaggaauuagcaucaagcgcgugacgauuuccggcaucucuaacgcgcagagccuccacgugaagaaagauaaggacgggaaacccauccuggacgaaaacggaagaaauauuccugucgauuucgugaacacaggcaauaaccaccauguugcuguguacuaucggcccgucaucgacaagagagggcagcuugugguugaugaggccggaaauccgaaauacgaacuggaggagguggucguguccuucuuugaagccguuacccgcgcuaaccucggccagccuauuaucgacaaggauuacaaaaccacagagggguggcaauuccuguuuucuaugaagcagaaugaauauuucguguuucccaacgagaagaccggcuucaauccuaaagaaauugaccuccuggaugucgagaacuacggacuuaucagccccaaucuguuucgggugcagaaguucucccugaaaaacuauguguuuagacaccaucucgagacaacgauuaaggacaccucuagcauccugcgcggcaucacauggauugauuuccgguccagcaaagggcuugacaccaucgucaagguuagagugaaucacauuggacaaaucgugucugucggcgaauacuga

SEQ ID NO: 4522 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagacauacaccgaguggaacaaagaaaaggggaaaacagagcagcaagaaaaggagcauaaacucgaaggaaucuacagcaagcgcaagcgggaugaggccaaaagagagaaucugcaguggcgcgugaacggccugaaggaaaaacucucccuggagcagcuugucauuguguuccaggaaaugaacacccaaaucaauaacagcucuggguaucugggagcuaucuccgaccggagcaaggagcucuacuuuaauaaacagaccgugggccaguaucagauggagaugcuggacaagaacccuaaugccucucuuagaaacauggucuucuaccgccaagauuaucuggacgaauuuaauaugcucugggagaagcaggcuguuuaccacaaagaacugacagaggaacugaagaaagagauucgggauaucauuaucuucuaucagagacgccucaagucccaaaaaggccugauuggguuuugcgaguucgaaagccggcagaucgagguggacaucgauggaaagaagaaaauuaagacggugggcaacagagucaucucucgcuccagcccccuuuuucaggaguucaaaauuuggcagauccugaauaacauugaagugaccguuguggggaagaaacggaagagacggaaacucaaggaaaauuacuccgcccuguucgaggagcugaacgacgcggaacaacuugagcucaauggaucucgcagacugugucaggaagagaaggaacugcucgcccaggagcuguuuauccgggauaaaaugacaaagagcgagguccuuaaacuccuguucgacaacccucaggaacuggaucugaauuuuaagaccaucgacggcaacaaaacaggguacgcucuuuuccaagccuauuccaagaugauugagaugagcggacaugaacccguggauuuuaagaaaccuguugagaagguggucgaguacaucaaagcuguguucgaccuccugaacuggaauaccgacauucugggcuuuaacucuaaugaggaacucgauaaccaguccuauuacaagcuguggcaccuucuguauagcuucgaaggcgacaauacgccgacagggaacggaagacucauccagaaaaugaccgagcuguacggcuuugaaaaggaguaugccaccauucuggccaaugucucuuuccaggaugacuacgggagccuuuccgcuaaggcgauccauaaaauucucccccaccugaaggagggaaaccgcuacgauguggccugcguuuaugcuggcuaccggcacucugaaagcucccugacaagagaggaaaucgccaauaaagugcucaaggaccgccugaugcuucugccuaaaaacagccuccauaaucccgucguggagaagauccugaaccaaaugguuaaugugauuaacgucaucauugauaucuaugggaagccugacgaaauuagaguggagcuggcccgggagcuuaaaaagaaugcuaaagaacgcgaggaacucaccaagucuaucgcccagacaacgaaagcgcacgaggaauacaagacccugcugcagacagaguuuggccucaccaacguguccagaacagauauccugcgguauaaacuuuacaaggagcuggaaagcuguggauauaagacccucuacucuaacacguacauuucccgcgagaaacuguucagcaaggaauuugacaucgagcauauuaucccccaggcuagacuguucgaugacuccuucucuaauaaaacccuugaggcccggagcguuaacauugaaaagggcaauaaaacagccuaugauuuugucaaggagaaguucggggaauccggagcugacaacucucuggagcacuaccucaauaacaucgaagaccuguuuaaaagcggcaagaucuccaaaaccaaguauaauaaacucaagauggccgagcaagauauuccggacggguucaucgagcgcgaucugagaaacacacaguacauugcuaagaaagcccuuagcaugcugaaugaaaucucucaccgggugguggcgaccuccggaagcgucacggacaagcuccgcgaggauuggcagcugauugacgugaugaaagaacugaacugggagaaguauaaagcccuuggccugguugaauacuuugaggauagagacgggcggcaaaucggcagaaucaaggauuggacaaagcgcaaugaccaucggcaccaugcuauggaugcccucaccguggcuuucacaaaagacgucuuuauucaguauuucaacaauaagaacgccucucuggauccuaaugcgaacgagcacgccaucaaaaacaaguacuuucagaauggcagagcuauugcccccaugccucuccgcgaguuccgggcugaagccaaaaagcaucuggaaaacacccuuaucuccauuaaggccaaaaauaaggugaucaccggaaacauuaauaaaacaagaaagaaagggggaguuaacaagaauaugcagcaaacgccccgcggccagcugcaccucgagaccaucuacgggagcggaaaacaguaucugacaaaggaagagaaggugaacgcuucuuuugacaugcggaaaaucggcaccgucagcaagcuggcguacagagacgcccuucugaaacgccucuaugagaaugauaacgaccccaagaaggcuuucgccgggaaaaauucccuggauaagcagccuauuuggcucgacaaagaacaaaugcggaaggugccggagaaaguuaagaucgugacacuggaagccauuuacaccaucagaaaagagauuagccccgaucuuaaggucgacaaggugaucgaugugggcguccggaaaauccugauugaccgccugaacgaguauggaaaugaugcuaagaaagccuuuucuaaccucgacgaaaauccuaucuggcugaacaaggagaaaggcauuuccaucaagagaguuacgauuagcgggaucuccaaugcgcagucucuucacgugaagaaagauaaggacggaaaacccauccuggacgaaaacggccggaacauuccuguggauuucgucaauacagggaacaaucaucacguggcuguuuacuaucgccccgugaucgacaagagaggacagcucgucguggaugaggccggcaacccgaaauacgaacuggaggagguuguggucagcuucuuugaagccgugacccgggcuaaucucgggcagccuauuaucgacaaggauuacaaaaccacagagggcuggcaauuccuguuuuccaugaagcagaacgaauauuucguuuuucccaaugagaagaccggauucaacccuaaagaaauugaccuucuggauguggagaauuacggccugaucucucccaaccucuuuagaguccagaaguucagccugaaaaauuauguguuucgccaucaccuugagacaacgauuaaggacaccuccucuauccugcgggggaucacauggauugauuucagaagcuccaaaggacucgacaccaucgugaagguccgcguuaaccacauuggccaaaucgugagcgugggggaauacuga

SEQ ID NO: 4523 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagaacuacacagaguggaauaaagaaaaggggaaaaccgagcagcaagaacgcgagcauaagcucgaaggaaucuacagcaaacggaagagagaugaggccaagcgcgagaaccugcaguggcgggugaacggccugaaagaaaagcucucccuggagcagcuugucauuguguuccaggaaaugaauacacaaaucaacaauagcucuggguaucugggagcuaucuccgacagaagcaaagagcucuacuuuaacaagcagaccgugggccaguaucagauggagaugcuggacaaaaauccuaacgccucucuucgcaauauggucuucuaccggcaagauuaucuggacgaauuuaacaugcucugggagaagcaggcuguuuaccacaaggaacugaccgaggaacugaaaaaggagauuagagauaucauuaucuucuaucagcgccggcucaaaucccaaaagggccugauuggguuuugcgaguucgaaagcagacagaucgagguggacaucgaugggaaaaagaagauuaaaacagugggcaaucgcgucaucucucgguccagcccccuuuuucaggaguucaagauuuggcagauccugaacaauauugaagugacgguuguggggaaaaagagaaaacggcgcaagcucaaagaaaacuacuccgcccuguucgaggagcugaaugacgcggaacaacuugagcucaacggaucuagacggcugugucaggaagagaaggaacugcucgcccaggagcuguuuaucagagauaagaugaccaaaagcgagguccuuaagcugcuuuucgacaauccucaggaacuggaucugaacuuuaaaacaaucgacggcaacaagaccggguacgcucuuuuccaagccuauuccaaaaugauugagaugagcggacaugaacccguggauuuuaagaagccuguugagaaaguggucgaguacaucaaggcuguguucgaccuccugaauuggaacacagacauucugggcuuuaauucuaacgaggaacucgauaaucagccguauuacaaacuguggcaccuucuguauuccuucgaaggcgacaacacccccacggggaauggacgccucauccagaagaugacagagcuguacggcuuugaaaaagaguaugccaccauucuggccaacgucagcuuccaggaugacuacgggucucuuagcgcuaaggcgauccauaagauucucccucaccugaaagagggaaaucgguacgauguggccugcguuuaugcuggcuacagacacuccgaaucuagccugacccgcgaggaaaucgccaacaaggugcucaaagacagacugaugcuucugcccaaaaauucccuccauaacccugucguggagaagauccugaaucaaaugguuaacgugauuaaugucaucauugauaucuaugggaagcccgacgaaauucggguggagcuggcccgcgagcuuaagaaaaacgcuaaggaaagagaggaacucacaaaaagcaucgcccagaccacaaaggcgcacgaggaauacaaaacgcugcugcagaccgaguuuggccucacaaacgugucucggaccgauauccugcgcuauaagcucuacaaagagcuggaauccuguggauauaagacacucuacagcaauaccuacauuucuagagagaagcuguucuccaaagaauuugacaucgagcauauuaucccgcaggcucggcuguucgaugacagcuucuccaacaagacgcuugaggcccgcucuguuaauauugaaaaaggcaacaagaccgccuaugauuuugucaaagagaaguucggggaaagcggagcugacaauucccuggagcacuaccucaacaauaucgaagaccuguuuaagucuggcaaaaucagcaagacaaaauauaacaagcucaaaauggccgagcaagauauuccugacggguucaucgagagagaucugcggaauacccaguacauugcuaagaaggcccuuuccaugcugaacgaaaucagccaccgcgugguggcgacaucuggauccgucaccgacaaacucagagaggauuggcagcugauugacgugaugaaggaacugaauugggagaaauauaaggcccuuggccugguugaauacuuugaggaucgggacgggagacaaaucggccgcaucaaagauuggacgaagcggaacgaccauagacaccaugcuauggaugcccucacaguggcuuucaccaaggacgucuuuauucaguauuucaauaacaaaaaugccagccuggaucccaacgcgaacgagcacgccaucaagaauaaauacuuucagaacggacgcgcuauugccccuaugccccuccgggaguucagagcugaagccaagaaacaucuggaaaauacacuuaucucuauuaaggccaagaacaaagugaucaccggcaauauuaacaagacccgcaaaaagggaggaguuaauaaaaacaugcagcaaacaccccggggccagcugcaccucgagacgaucuacggguccggaaagcaguaucugaccaaagaagagaaggugaaugcuagcuuugacaugagaaagaucggcacagucucuaaaagcgcguaccgcgacgcccugcuuaagcggcuguaugagaacgauaaugacccuaaaaaggcuuucgccgggaaaaacucccucgauaagcagccgauuuggcuggacaaggaacaaaugagaaaagugcccgagaagguuaaaaucgugacccucgaagccauuuacacaauccggaaggagauuagcucugaucugaaagucgacaaggugaucgaugugggcguccgcaagauccuuauugacagacugaaugaguauggaaacgaugcuaaaaaggccuuuuccaaucuggacaaaaacccuaucuggcucaauaaggaaaaaggcauuagcaucaagcggguuaccauuuccgggaucucuaacgcgcagagccugcacgugaagaaagauaaggacggaaaacccauccuugacgagaacggccgcaauauuccuguggauuucgucaacacggggaauaaccaucacguggcuguuuacuauagacccgugaucgacaagcggggacagcuggucguggaugaagccggcaauccgaaauacgagcucgaagagguuguggucuccuucuuugaggccgugacaagagcuaaccuggggcucccuauuaucgacaaggauuacaaaaccaccgaaggcuggcaguuccuguuuucuaugaagcaaaaugaguauuucguuuuucccaacgaaaagacaggauucaauccuaaagagauugaccuucuggauguggaaaacuacggccugaucagccccaaucucuuucgcguccagaaguucucccugaaaaacuauguguuucggcaucaccuugagaccacaauuaaggacacgucuagcauccugagagggaucaccuggauugauuuccgcuccagcaaaggacucgacacaaucgugaagguccggguuaaucacauuggccagaucgugucugugggggaguacuga

SEQ ID NO: 4524 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagaacuacacagaguggaauaaagaaaaggggaaaaccgagcagcaagaacgcgagcauaagcucgaaggaaucuacagcaaacggaagagagaugaggccaagcgcgagaaccugcaguggcgggugaacggccugaaagaaaagcucucccuggagcagcuugucauuguguuccaggaaaugaauacacaaaucaacaauagcucuggguaucugggagcuaucuccgacagaagcaaagagcucuacuuuaacaagcagaccgugggccagugccagauggagaugcuggacaaaaauccuaacgccucucuucgcaauauggucuucuaucggcaagauuaccuggacgaauuuaacaugcucugggagaagcaggcuguuuaucacaaggaacugaccgaggaacugaaaaaggagauuagagauaucauuaucuucuaccagcgccggcucaaaucccaaaagggccugauuggguuuugugaguucgaaagcagacagaucgagguggacaucgaugggaaaaagaagauuaaaacagugggcaaucgcgucaucucucgguccagcccccuuuuucaggaguucaagauuuggcagauccugaacaauauugaagugacgguuguggggaaaaagagaaaacggcgcaagcucaaagaaaacuauuccgcccuguucgaggagcugaaugacgcggaacaacuugagcucaacggaucuagacggcugugccaggaagagaaggaacugcucgcccaggagcuguuuaucagagauaagaugaccaaaagcgagguccuuaagcugcuuuucgacaauccucaggaacuggaucugaacuuuaaaacaaucgacggcaacaagaccggguacgcucuuuuccaagccuacuccaaaaugauugagaugagcggacaugaacccguggauuuuaagaagccuguugagaaaguggucgaguauaucaaggcuguguucgaccuccugaauuggaacacagacauucugggcuuuaauucuaacgaggaacucgauaaucagccguacuauaaacuguggcaccuucuguacuccuucgaaggcgacaacacccccacggggaauggacgccucauccagaagaugacagagcuguauggcuuugaaaaagaguacgccaccauucuggccaacgucagcuuccaggaugacuaugggucucuuagcgcuaaggcgauccauaagauucucccucaccugaaagagggaaaucgguacgauguggccuguguuuacgcuggcuauagacacuccgaaucuagccugacccgcgaggaaaucgccaacaaggugcucaaagacagacugaugcuucugcccaaaaauucccuccauaacccugucguggagaagauccugaaucaaaugguuaacgugauuaaugucaucauugauaucuacgggaagcccgacgaaauucggguggagcuggcccgcgagcuuaagaaaaacgcuaaggaaagagaggaacucacaaaaagcaucgcccagaccacaaaggcgcacgaggaauauaaaacgcugcugcagaccgaguuuggccucacaaacgugucucggaccgauauccugcgcuacaagcucuauaaagagcuggaauccugcggauacaagacacucuauagcaauaccuacauuucuagagagaagcuguucuccaaagaauuugacaucgagcauauuaucccgcaggcucggcuguucgaugacagcuucuccaacaagacgcuugaggcccgcucuguuaauauugaaaaaggcaacaagaccgccuacgauuuugucaaagagaaguucggggaaagcggagcugacaauucccuggagcacuaucucaacaauaucgaagaccuguuuaagucuggcaaaaucagcaagacaaaauacaacaagcucaaaauggccgagcaagauauuccugacggguucaucgagagagaucugcggaauacccaguauauugcuaagaaggcccuuuccaugcugaacgaaaucagccaccgcgugguggcgacaucuggauccgucaccgacaaacucagagaggauuggcagcugauugacgugaugaaggaacugaauugggagaaauacaaggcccuuggccugguugaauauuuugaggaucgggacgggagacaaaucggccgcaucaaagauuggacgaagcggaacgaccauagacaccaugcuauggaugcccucacaguggcuuucaccaaggacgucuuuauucaguacuucaauaacaaaaaugccagccuggaucccaacgcgaacgagcacgccaucaagaauaaauauuuucagaacggacgcgcuauugccccuaugccccuccgggaguucagagcugaagccaagaaacaucuggaaaauacacuuaucucuauuaaggccaagaacaaagugaucaccggcaauauuaacaagacccgcaaaaagggaggaguuaauaaaaacaugcagcaaacaccccggggccagcugcaccucgagacgaucuacggguccggaaagcaguaccugaccaaagaagagaaggugaaugcuagcuuugacaugagaaagaucggcacagucucuaaaagcgcguaucgcgacgcccugcuuaagcggcuguacgagaacgauaaugacccuaaaaaggcuuucgccgggaaaaacucccucgauaagcagccgauuuggcuggacaaggaacaaaugagaaaagugcccgagaagguuaaaaucgugacccucgaagccauuuauacaauccggaaggagauuagcccugaucugaaagucgacaaggugaucgaugugggcguccgcaagauccuuauugacagacugaaugaguacggaaacgaugcuaaaaaggccuuuucuaaucuggacaaaaaccccaucuggcucaauaaggaaaaaggcauuuccaucaagcggguuaccauuagcgggaucuccaacgcgcagucucugcacgugaagaaagauaaggacggaaaaccuauccuugacgagaacggccgcaauauucccguggauuucgucaacacggggaauaaccaucacguggcuguuuauuacagaccggugaucgacaagcggggacagcuggucguggaugaagccggcaauccuaaauaugagcucgaagagguuguggucagcuucuuugaggccgugacaagagcuaaccuggggcuccccauuaucgacaaggauuacaaaaccaccgaaggcuggcaguuccuguuuuccaugaagcaaaaugaguacuucguuuuuccuaacgaaaagacaggauucaaucccaaagagauugaccuucuggauguggaaaacuauggccugaucucuccuaaucucuuucgcguccagaaguucagccugaaaaacuacguguuucggcaucaccuugagaccacaauuaaggacacguccucuauccugagagggaucaccuggauugauuuccgcagcuccaaaggacucgacacaaucgugaagguccggguuaaucacauuggccagaucgugagcgugggggaguauuga

SEQ ID NO: 4525 - RNA, 4311 nt, Artificial Sequence
  Cas9 variant
augaagagaauccugggccucgaccuggggaccaacagcauuggaugggcccuugugaaugaggcugaaaacaaagaugagcgguccucuaucgucaagcugggcguucgcgugaauccccucacaguggacgaacugacgaacuucgagaaaggaaagagcauuaccacaaaugccgauagaacccuuaaacggggaaugcgcagaaaccugcagcgguacaagcuccgcagagaaacacugaccgagguccugaaggagcacaaacucaucacagaagacaccauucuguccgagaauggcaaccggacgaccuuugaaacauaucgccuuagagcgaaggcugugaccgaggagaucucucuggaagaguucgcccggguucuccugaugaucaauaaaaagcgcggguacaaaagcuccagaaaggccaagggaguggaagagggcacacuuauugauggcauggacaucgcucgggaacuguauaacaauaaccucaccccuggggagcugugccugcaacuccuggaugccgggaaaaaguuucuuccggacuucuaccgcucugaucugcagaaugagcucgacagaauuugggaaaaacagaaggaguauuaccccgaaauccugacggauguccuuaaagaggaacugcggggcaagaaaagagacgcugugugggccauuugugcgaaguauuuuguuuggaaggagacauacaccgaguggaacaaagaaaaggggaaaacagagcagcaagaacgcgagcauaagcucgaaggaaucuacagcaaacggaagagagaugaggccaagcgcgagaaucugcaguggcgggugaacggccugaaagaaaagcucucccuggagcagcuugucauuguguuccaggaaaugaacacccaaaucaauaacagcucuggguaucugggagcuaucuccgacagaagcaaagagcucuacuuuaauaagcagaccgugggccaguaucagauggagaugcuggacaaaaacccuaaugccucucuucgcaacauggucuucuaccggcaagauuaucuggacgaauuuaauaugcucugggagaagcaggcuguuuaccacaaggaacugacagaggaacugaaaaaggagauuagagauaucauuaucuucuaucagcgccggcucaaaucccaaaagggccugauuggguuuugcgaguucgaaagcagacagaucgagguggacaucgaugggaaaaagaagauuaaaacggugggcaaccgcgucaucucucgguccagcccccuuuuucaggaguucaagauuuggcagauccugaauaacauugaggugaccguuguggggaaaaagagaaaacggcgcaagcucaaagaaaauuacuccgccaucuucgaggagcugaacgacgcggaacaacuggagcuuaauggaucuagacggcucugucaggaagagaaggaacugcuggcccaggagcucuuugucagagauaagaugacaaaaagcgaggugcugaagcugcuguucgacaacccucaggaacucgaucugaauuuuaaaaccaucgacggcaacaagacaggguacgcucuguuccaagccuauuccaaaaugauugagaugagcggacaugaacccguugauuuuaagaagccuguggagaaagucguggaguacaucaaggcugucuucgaccuucucaacuggaauaccgacauucugggcuuuaacucuaaugaagaacuggauaaccaguccuauuacaaacucuggcaccuucuuuauagcuucgaaggcgacaauacgccgacagggaacggacgccugauccagaagaugaccgagcucuacggcuuugaaaaagaguaugccaccauucuggccaaugugucuuuccaggaugacuacgggagccuguccgcuaaggcgauccauaagauucuuccccaccucaaagagggaaaccgguacgauguugccugcguguaugcuggcuacagacacucugaaagcucccugacacgcgaggaaaucgccaauaagguccugaaagacagacucaugcugcuuccuaagaacagccugcauaaucccgugguugagaaaauccucaaccaaauggugaaugucauuaacgugaucauugauaucuaugggaagccugacgaaauucggguggagcuggcccgcgagcugaagaaaaaugcuaaggaaagagaggaacuuaccaaaucuaucgcccagacaacgaaggcgaacgaggaauacaaaacccuccugcagacagaguuuggccugaccaacguuucccggacagauauccuccgcuauaagcuguacaaagagcuugaaagcuguggauauaagacccuguacucuaauacguacauuuccagagagaaacucuucagcaaggaauuugacaucgagcacauuaucccccaggcucggcuguucgaugacuccuucucuaacaagacccuggaggcccgcagcgucaauauugaaaaaggcaacaagacagccuaugauuuugugaaagagaaguucggggaauccggagcugacaauucucuugagcauuaccugaacaauaucgaagaccucuuuaagagcggcaaaaucuccaagaccaaauauaacaagcugaaaauggccgagcaagauauuccggacggguucaucgagagagaucuccggaauacacaguacauugcuaagaaggcccugagcaugcuuaacgaaaucucucaccgcguggucgcgaccuccggaagcgugacggacaaacugagagaggauuggcagcucauugacguuaugaaggaacugaauugggagaaauauaaggcccugggccuuguggaauacuuugaggaucgggacgggagacaaaucggccgcaucaaagauuggacaaagcggaacgaccacagacaucacgcuauggaugcccugaccgucgcuuucacaaaggacguguuuauucaguauuucaauaacaaaaaugccucucucgauccuaacgcgaacgagcaugccaucaagaauaaauacuuucagaacggacgcgcuauugcccccaugccucugcgggaguucagagcugaagccaagaaacaccucgaaaauacccugaucuccauuaaggccaagaacaaaguuaucaccggcaauauuaacaagacacgcaaaaagggaggagugaauaaaaacaugcagcaaacgccccggggccagcuucaucuggagaccaucuacgggagcggaaagcaguaucucacaaaagaagagaaggucaaugcuucuuuugacaugagaaagaucgagaccgugagcaaauccgcguaccgcgacgcccugcugaagcggcuuuaugaaaacgauaaugaccccaaaaaggcuuucgccggcaaaaacagccuggauaagcagccuauuuggcucgacaaggagcaaaugagaaaaguuccggaaaaggugaaaaucgucacacuggaggccauuuacaccauccggaaggagauuucucccgaucucaaaguggacaaggugaucgaugucgggguucgcaagauccugauugacagacuuaaugaauauggcaacgaugcuaaaaaggccuuuuccaaucuggacaaaaacccuaucuggcugaauaaggagaaaggaauuagcaucaagcgggugacgauuuccggcaucucuaacgcgcagagccuccacgugaagaaagauaaggacgggaaacccauccuggacgaaaacggacgcaauauuccugucgauuucgugaacacaggcaauaaccaccauguugcuguguacuauagacccgucaucgacaagcgggggcagcuugugguugaugaggccggaaauccgaaauacgaacuggaggagguggucguguccuucuuugaagccguuaccagagcuaaccucggccugccuauuaucgacaaggauuacaaaaccacagagggguggcaguuccucuuuucuaugaagcaaaaugaauauuucguguuucccaacgagaagauuggcuucaauccuaaagaaaucgaccugcuugaugucgagaacuacggacugauuagccccaaucuguuucgcgugcagaaguucucccucaaaaacuauguguuucggcaccaucuggagaccacaaucaaggacacgucuagcauccuuagaggcauuaccuggaucgauuuccgcuccagcaaagggcuggacacaauugucaagguucgggugaaucacaucggacagauugugucugucggcgaauacuga

SEQ ID NO: 4526 - RNA, 4311 nt, Artificial Sequence
  Cas9 variant
augaagagaauccugggccucgaccuggggaccaacagcauuggaugggcccuuguggaugaggcugaaaauaaagacgagcgguccucuaucgucaagcugggcguucgcgugaacccccucacaguggaugaacugacgaauuucgagaaaggaaagagcauuaccacaaacgccgacagaacccuuaaacggggaaugcgcagaaaucugcagcgguacaagcuccgcagagaaacacugauggagguccugaaggagcacaaacucaucaccgaagauacaauucuguccgagaacggcaaucggaccacguuugaaaccuaucgccuuagagcgaaggcugccacagagaaaaucucucuggaggaguucgcccgggugcuccugaugaucaacaagaaacgcggguacaagagcugcagaaaggcuaaaggagccgaagaaggcacccuuauugacggcauggauaucgcucgggagcuguauaauaacaaucucacaccuggggaacugugucugcaacuccuggacgccggaaagaaauaccuuccggauuuuuaucgcuccgaccugcagaacgagcucgauagaauuugggagaagcagaaagaauacuaucccgagauccugaccgaaguucuuaaggaggaacugcggggcaaaaagagagacgcggugugggccauuugcgcuaagucuuucgucugggaggaguacuacacggaauggaauaaagagaaggggaaaacagaacagcaagagcgcgaacauaagcucgagggaaucuauagcaaacggaagagagaugaggccaagcgcgaaaaccugcaguggcgggugaauggccugaaagagaagcucucccuggaacagcuuguuauugugcugcaggagaugaacauccaaaucaacaauagcucuggguaccucggagcuauuuccgacagaagcaaagagcuguauuuuaacaagcagaccgucggccaguaccagauggaaaugcuugacaaaaauccuaacgccucucugcgcaauaugguguucuaucggcaagauuaccucgacgaguuuaacacacugugggaaaagcaggcggaguaucacaaggaacugaccggcgagcucaaaaaggagaucagagauauugugaucuucuaccagcgccggcugaaaucccaaaaggggcuugucggauuuugugaguucgaaagcagacagauugaaguugagaucgacggcaaaaagaagaucaaaaccguggggaaucgcgugauuccccggucuuccccucuguuucaggaguucaagaucuggcagauucucaacaauaucgaagucacagugguugggaaaaagggcaaaagacggaagcaaaaagauaacagccccacgcuguuugacgggcuggaugacaccgagcagcuugaacucaauggaucccgcuaccuguaucaggaggaaaaggagcugcucgcccaggaacuguucgugagagauaagaugacaaaaucugacguccuuaagcuccuguucgauaacccucaagagcuggaccugaauuuuaaaaccauugacggcaacaagacaggcuacacccuuuuccaggcuuauagcaaaaugaucgagauguccgggcaugaaccgguggauuuuaagaagacgguugagaaaguggucgaacacgugaaggccgucuucgaccuccugaauuggaacacagauauccugggauuuaacagcaaugaggagcucgacaaccagucuuacuauaaacuguggcaucuucuguacuccuucgaaggcgauaauacccccaccgggaacgcucggcucgugcagaagauuacagagcuguauggauuugaaaaagaguacgccaucauucuggccaauguuaccuuccaagacgauuacggcagccuuucugcuaaggcgauccacaagauucucccucaccugaaagaagggaacagauaugacguggccugcgcuuacgccggcuauaagcauagcgaguccucucugacaaaagaggaaaucgccaauaaggcucucaaagaucgccugacgcuucugcccaagaacaaucuccggaacccugucguggagaagauucugaaucagaugguuaacgugaucaaugccaucauugacaccuacggaaaacccgaugaaaucagagucgagcuggcgcgcgaacuuaagaaaaacgcuaaggagagagaggaacucacaaaauuuauugccgagaccacacggaagcacgaagaguucaaaauccugcugcagagcgaauuuggccucaccaaugugucccgcacggacauucugagauauaaacuuuacaaggagcuggagagcuguggguauaaaacccucuacucuaacacauacaucccgcgggaaaagcuguucuccaaagaguuugauaucgaacauauuaucccucaggcccgccuguucgacgacagcuucucuaacaagacccuugaggcuagauccauuaaucuggagaaaggaaacaagacagccuaugauuuugugaaggaaaaauucggcgagagcggggcugacaauucccucgaucacuaccugaacaauaucgaagaccucuuuaagucuggaaaaauuagcaagaccaaauauaacaagcugaagauggccgagcaagauauccccgacggcuucaucaaucgggaucuucgcaacacgcaguacauugcgaaaaaggcccuguccaugcucaaugaaaucucuagacggguugucgcuacaagcgggaccauuacagacaaacugcgccaggauuggcaacugguggacgugaugaaggagcuuaacugggagaaauauaaggcccugggccucgucgaauacuuugaggauaaggacggaagacagaucggccggauuaaagauuggaccaagagaaaugaccaccgccaucacgcuauggacgcccugaccguggcguucacaaaagauaucuuuauccaguauuucaacaauaagaacgccucccucaauagcaacacgaacgaauacgcuauuaaaaauaaguacuuucagaacgggcgggccaucgcuccuauuccccugagagaguuccgcguugaagccaagaaacaucuugagaauacccugaucucuauuaaggccaaaaacaagguggucacaggaaauaucaacaaaaccaagaaacggggcggggugaauaaguaucuccaacagacacccagaggacagcugcaccuggagaccauuuacggcuccgggaagcaguaucuuacgaaagaagagaagguuaacgcuagcuuugacaugaaaaagaucgcgacagugucuaaauccgccuaccgcgauguccugcucaagcggcugcaugaaaaugacaacgauccuaagaaggcuuucaccggcaagaauagccucgacaaacaaccgaucuggcuggauaaggagcagaccagaaaagugcccgaaaagguuaagacagugacccuugagacaauuuauacgguccgcaaagagaucucuccugaccugaagguggauaaagugauugacgccggaguccggaagauccugaccggcagacucaacgaauacgggaaugaugccaaaaaggcuuuuagcaaccuggacgagaaucccauuuggcuuaacaaggaaaaaggaaucuccaucaagcggguuacaauuagcggcaucucuaaugcccagucccugcacgugaaaaaggacaaagaugggaagccuauucucgacgaggauagccgcaacauccccguggacuucgucaacaccggaaauaaccaccauguggcgguuuauagacggccggugauugauaaacgcggccagcuggucaucgacgaggcugggaauccuaaguacgaacucgaggaagugguuguguccuucuuugaggccgucacaagagccaaccugggccaacccaucauugauaaggacuacaaaaccucugaaggauggcaguuccuuuuuagcaugaagcagaaugaguauuucguguuuccuaacgagaaaacgggcuucaaucccaaggaaaucgaucugcuggacgcugagaacuacgggguuauuuccccuaaucucuuucgggugcaaaaauucgcccacaagaacuaugucuuuagacaucaccuggaaaccacaaucaaggauaccucuagcauucuuaaaggaaucacauggauugacuuccgcuccucuaagggccuggaugcgaucgugaaagugcgggucaaucacaucgggcagauuguuagcgugggagaguacuga

SEQ ID NO: 4527 - RNA, 4311 nt, Artificial Sequence
  Cas9 variant
augaaguacaucaaauauauucugggccucgacaucgggagcaacuccauuggaugggcccugauccagcuugaucugcuccaaaagaccaaaagaauuaucgcugccggcucucggaucauucccauggaccagaaggugcugagcgauuucgggaaaggaaucacaauuuccccuacggcgcagcgcaccucuuacagaaaugcucggcacugccgcgagagacaucuucugcggcgcgaaagacuccaccggguccugcauauccugggcuuucucccgacacacuaugacaagcagauugauuucagcaagcgcuacgggaaauuuguugacaacaccgagcccaagaucgccuauaaugaaggaaaauuccuguuuauggauuccuuccaagagaugcuuucugacuuuaagagccaucagccugaucuguucuacacaaagaagaacggcgaagaguccaagauucccuaugacuggaccaucuacuaccucagaaagaaggcccugagccagaaaaucucuaaggaggaacuugcuuggauuauccugaauuuuaaccagaaacggggcuauuaccaacuccgcgaggaagaggggaauaaggagaacgauuucgaaauuaucuccagcaaaauuaucucugugaucaagaaggacaaagauaagaaauauaauaaguacugguaugacauuauccuggagaacggacugguguaccaggccgcuuuuuauaaugacuucgucuacaacuggauuaaucaggauagagaauuuaucauugagcggacaucccucaaaaacggcgccgaaaaggugaagcugagcuaccuuccuaccuucgacgagaucgauaaaauggacaagaaagagcaggauaaguauuacaaaaagaucaagauuaaaacggaaaauucuaucgggaacaagaccguuggauguuauauuuacgaccacauccugcaaaaccccaaugagaaaauuaagggcaaacucgugcgcacaaucgaaagaaaguauuacaaggaggaacugaaagcgauucuugagaagcagaucgcccugcagccugaacucuucaccgaucaacugcuggcugacugcauccgggaacucuauuccaaaaacgaggcccagcagagaaaucuggcugcccgcgauuuuguccaccuucugguggaagacauuaucuucuaccagcggccgcucagacgccaaaagagcacacuggcgaacuguucccuugagucucggagcuacauugauaaagacucccauaccagaaaggaagcuccccugaaaguuugcccuaagagcaaucccuauuaccaggaguuucgcgugcuccaguggcugcagaaccugaagaucuaugagauugacucugaucaagaagucacgcaccaguucaucaaaacacucgaggacaagcagcagcuguuugaguuccuuauggcccaaaaagagaucgauugugaggaacugcucaaguacuuucugaaucagaccuauccuaacgccaaagagaaggcucugaaguccgaacuuaaaaaguggaaagacacauaccgguggaauuauguguacgauauuggggaaaagagcucuaaaaaguaccccaugaacgaaaccagauaugagcucaagcgccaucuggagaaaguggccaaucugccggacgauuuccucagcuccgaagucgaguaccugcuuuggcaccugaucuauucuguuaaggacaaaguggccuacgaaaagggacucaaaaaguuugcucagaagcaccaucuggauaaagacagcuucguggaguccuuuaagaaauucaacccuuaucccagcgaauacggcucuuuuuccgagaaggcgauucggaaacugcuuccucucaugagauucggcgcccacugggauuucaaucauaucgacaagaacacccagaaacgcauugaggaucugaucacaggggucgaaaaugaggaaauccggacgauucugagagagaaggcugaaaaguaucaacucgagaaagagaccgacuuucaggaccugccccuuuggcuggcccaguacaucguguacaaccggcacgccgaagcuagcucucucgagaaguggacauccguuaacgaucuggaaaccuaucugaaugaguucaaacaacauagccuucgcaaccccauuguggagcaggucgugauggaaacacucagaguugugcgggacaucuggcagcaguacggacaaggccaggccuccuuuuucaaugagauucacaucgaacuggggagagagcugaagaaaaccgcgaaggaacgcgagaagcucucuaaacagaaccagaagaaugaggauaucaaccugagcauuaaagaaaaacuuaaagagcuggaaaaguauaauacgcgggcuuacuccaucacacaccaagagaaguauaaacucuggcuggaacagaagcauauuucuccuuacaccggacagaucauuagcccggagaaccuguuuaccgacaauuaugagaucgaacacauuaucccccaguccagauucuuugaugacagccuuucuaacaaagucgugugcgaguccaucgucaauaaggccccuuacaaagaucgccaacucggccuggaguucauuaagaaccagggaggaagaaucgugaaggagcugagcaaagaaaauaagacaauuaaaaucuuuaccgaggagcaguaccggacauucauuaaggaacauuauucuaacaaucccgagaaaacgaagaagcuccugcuugaagagaucccugagaaaaugguugcccgccaaaugaacgacaccuguuacaucuccaaguuuauuagcgaaauccugucuaaaauugugagaagcgaugagcaggacgaaggcguccacuccaagaacgugauccucugcacaggcaaaauuaccagcauccugcggcaggauugggggcugaaugacaucugggauaaccuuauucugccccgcuucgagagaaugaauaaccuccugcagaaggaaaaauuuacaaucuauucuauugagaagcaaaagaaaaucccgguugugccuauuaaugaccaguucaaguccuuccagaaaaagcggaucgaccaccgccaucacgcuauggaugccauuaucaucgcuuguaccacgagagagcauauuaacuacaucaauaaccagcacgcccucgaaaaagagaaggacaagaaagaaaagcaagaggaacgggauaaacugcgcgagaaacuuugcauuaaaaaguauaauaacagaagcgagggaaauuacuccuggaucuuuaagaaacccugggacaccuucacacaggaaguccggguggcgcuggaggauauugugguuucuuuuaagcagaaccucagagucaucaauaaagccaccaacuauuacgaacgcuggguggaggaaaauggcaaguacaucaaaaagauggugaagcaggaggggacaaacugggcuauucggaaaccucugcaugaggaaaccaucagcggaaagauuuaucuggacagagagaaaaucacgaagaacgauauucuuacagccacccgcaaaacagucgacuccucuuucgaugacaagcggaucaaaaagaucaccgauaccggcauucaaaagauccugcucaauuaccugaaauauaaggggagccccgaaauugcuuuuuccccugagggccucgaggaacugaacaaaaaucuuucuaucuacaacgacggaaagccccacaaaccgauuuauaaggugagaaucuacgagaagggcagcgggcgcuucgcccugggagaaaaaggccggaaguauaaaaaguacguucagggggcguccaaucucuacuuuggaauuuaucagggcgccaaacgcagcuucgcuacaaucccucugaacgaggugaucgaaagacagaagcaagggcugcccucuguccccgaguacaaugagaagggcgaccuucugcucuuuucccugagcccuaacgaucucguguauguuccgauugaaggagagaucauugaaaauaucgacuuccggaaccugucuaaagagcagaaggaaagaauuuacaaugugaacgauuuuuccagcacguguuauuucacccccaaucggaucgccaaagcuaucuucccuaaggaggucgaccuucagcgcaaaggcgauaagcugucuggguccuacgacacaaagaccgccagccuggaggggauucaaaucaaagaagugugcauuaagcucaaaguugauagacugggcaacaucuccaaggccuga

SEQ ID NO: 4528 - RNA, 4314 nt, Artificial Sequence
  Cas9 variant
augaaguacaucaaauauauucugggccucgacaucgggagcaacuccauuggaugggcccugauccagcuugaucugcuccaaaagaccaaaagaauuaucgcuacaggcucucggaucauucccauggaccagaaggugcugagcgauuucgggaaaggaaucacgauuuccccuaccgcccagcgcacaucuuacagaaaugcgcggcacugccgcgagagacaucuucugcggcgcgaaagacuccaccggguccugcauauccugggcuuucucccgacccacuaugacaagcagauugauuucagcaagcgcuacgggaaauuuguugacaacacagagcccaagaucgcuuauaaugaaagaaaauuccuguuuauggauuccuuccaagagaugcuugccgacuuuaagauucaucagccugaucuguucuacaccaaaaagaacggagaagagucuaagauccccuaugacuggacaaucuacuaccuccggaaaaaggcccugagccgcaaaauuuccaaggaggaacuugcuuggaucauucugaauuuuaaccagaaaagaggcuauuaccagcuccgggaggaagaggaggaaaauaaggagaacgauuucgaaaucauuagcucuaaaaucaucuccgugauuaagaaggacaaagauaagaaauauaauaaguacugguaugacaucauucuggagaacggccugguguaccaagccgcuuuuuauaaugacuucgucuacaacuggaucaaucaggaucgcgaauuuauuaucgagagaaucagccucaaaaacgggaccgagaaggugaagcugucuuaccuuccuacguucgacgaaauugauaaaauggacaagaaagagcaggauaaguauuacaaaaagaucaagauuaaaaccgaaaauuccaucggaaacaagacaguuggcuguuauauuuacgaccacauccugcagaaccccaaugagaaaauuaaggggaaacucgugcggaccaucgaaagaaaguauuacaaggaggagcugaaagccauccuugaaaagcaagucgcgcugcagccugaacucuucacagaucagcuguuugccgacugcauucgcgaacuguauagcaaaaacgaggcucaacagcggaaucucgccgcuagagauuucgugcaccuguuuguugaagacaucauuuucuaccagcgcucucuucggagacagaaguccacccuggccaacuguagccucgagucccgcucuuacaucgauaaagacagccauacgcggaaggaggcgccgcugaaagugugccccaaguccaauccuuauuaccaagaauuuagaguccuucaguggcugcagaaccucaagauuuaugagaucgacacagaucaggaagugacccacgaguucaucaaaacacuggaggacaagcaacaguuuuucgauuuucugaugaaucagaaagaaauugacugugaggaacuccugaaguacuuccuuaaccagaccuaucccaaugcccgcgagaaagcucugaaguccgaacucaagaaauggaaggauaccuaccgguggaacuauguguacgacaucggagagaaaucuuccaagaaauacccuaugaaugagacaagauaugaacugaagcgccaucuggagaaggucgccaaccuucccgaugacuuucucagcucugaaguugaguaccugcuguggcaccucauuuauagcgugaaagauaagguggcuuacgaaaaaggccugaagacguucgcccaaaaacaccaucuugacaaggauuccuuugucgagucuuucaagaaauucaagccguauccuagcgaguacggguccuuuagcgaaaaagccauccggaagcugcucccccugaugagauucggaucuuauugggacuuuaaucacauugauaaaaacacccagaagcggaucgaggaccugaucacaggcguggaaaaugaggaaauucgcaccauccuuagagagaaagcugagaaguaccagcucgaaaaggagacagacuuccaggaucugccucuguggcucgcgcaauacauuguuuauaaccggcaugccgaagcuagcagccuggagaaauggaccucugugaacgaccuugagacguaccugaaugaauuuaagcaguauucccucagaaaccccaucgucgaacaggugguuauggaaacacugcgcgugguccgggauauuuggcaacaguacggccaggggcaggccagcuucuuugacgagauccacaucgaacugggaagagagcuuaaaaagaccgccaaagagcgcgaaaagcucuccaagcaaaaucagaaaaacgaggauauuaaucugucuaucaaggaaaaacugaaggagcucgaaaaauauaacaccagagcuuacagcauuacacaucaggagaaguauaagcuguggcuugagcagaaacacaucucccccuacaccggccaaauuaucucuccugaaaaucuguucacagacaacuacgagauugaacacaucaucccgcagagccgguuuuucgaugacucccucagcaauaagguggucugcgagucuauugugaacaaagcccccuauaaggaucgccagcuggggcuggaauuuaucaaaaaucagggaggcagaauuguuaaggagcuuuccacggagaacaagaccaucaaaauuuucacagaggagcaauaccggaccuuuaucaaggaacauuauagcaauaacccugagaaaacaaagaaacuccugcuggaggaaauccccgagaagaugguggcgcgccagaugaaugacaccuguuacauuucuaaguucaucuccgaaauucucagcaaaaucgucagaucugaugagcaggacgaaggggugcacagcaagaacguuauucugugcacgggaaaaaucaccuccgcucuuaagcaagauuggggcgugaacgacgucuggaaugaccugauccucccucgguucgagcgcaugaacgaucugacacagagcacccuguuuacaaccuauaaugagaaauaccagaaguaucuucccacggugccgauggaauacucuaacggcuuccagaaaaagagaauugaccaucggcaccacgccauggaugccaucauuaucgcuugugccacacgcgagcauauuaauuacaucaacaaucaacacgcucuggaaaaggggaaagacaagaaagagaagcagaaagaacaugauaagcucagagagaagcugugcauuaaaaaggacaacaaaggauccgaggaaaauuauagcuggaucuuuaagaaaccuugggauaccuucacacaggaggugcaggccgcgcucgaaggcaucguugucuccuuuaagcaaaaccugcgggugauuaauaaggccaccaacuacuaugagagauggguggaagagaaugggaaauacaucaagaaaauggucaagcaggagggaaccaacugggcuauucgcaaaccccuucacgaagagacaaucucuggcaagauuuaucuggaccgggaagagaucacgaagaaugauauccucaccgccacaagaaaaaccguggacagcuccuucgaugagaagcgcauuaaaaagaucacagacaccgggauucagaaaauccugcugaacuaccuuaaguauaaaggcucuccugaaauugcuuuuagccccgagggacuggaggagcucaacaagaaucuguccaucuacaacgacggcaagccucauaaacccaucuacaagguucggauuuaugaaaaagggucuggaagauucgcccucggcgagaaggggcgcaaauacaagaaguaugugcagggagcgccgaaucuguacuuuggcaucuaucaaggggccaacaaacggagcuucgcuacgauuccucuuaaugaggucaucgaaagacagaagcagggccgccccuccauucccgaguacaacgaaaaaggagauccucugcucuuuagccugucuccgaaugaccugguguauguucccguggagggcgaaaucauugaggauaucgacuuccagaaccuuuccaaggagcaaaaagaacggaucuacaaugucaacgauuucagcucuacauguuacuuuaccccuaauagaauugccaaggcuaucuuccccaaggagguggaccugcagcggaaaggggauaagcucccuggauccuaugacaccaaaacagccagccuggaaggcauucagaucaaggagguuugcauuaaacucaagaucgaucgccuggggaacaucucuaaggccuga

SEQ ID NO: 4529 - RNA, 4317 nt, Artificial Sequence
  Cas9 variant
augaagaccauccugggccucgaccuggggacaaacagcauuggaugggcccuuaucaaacagaauuucgagaacaaguacggcgaaauucuggggaugggauccagaaucauucccaugucucaagauauccucggcgaguuugggaaaggaaauagcgugucccagacggcugcccggaccgacuaucgcgcgacaagacggcugcgcgaaagauuccuucugcggcgcgagagacuccaccggguccugaacguucugaauuuucucccugaacauuacgcuucucagaucgauuucgacaagcgcuuuggcaaauucaagguggagaccgagccgaagcuggccuggaaaaacauugauggcaaguuuagcuuccuuuuucagacauccuucaaugaaaugcuggaggacuuuaaagcccacgggcaagaucucaaggugcccuaugacuggaccaucuacuaucugagaaagaaggcucuuucucagaagauugaaaaagaggagcuggucuggauccuccugaacuucaaucagaagcggggauacuaucagcugcgcggcgaagaggaagaggaaaacccuaauaaacucauugaguuuuacagccugaagaucauugaugugcuugccgacgagccccaaaaagggaaguccgauaucugguacagccugguucucgaaaacggauggaucuauagacggucuuccaaaacaagccugcuugacuggaaggauaagauucgcgacuucaucgugaccacggaccugaaugaugacggcucugucaaaaccgauaaggaggggaacgagaaaagauccuuccgggcuccuggagaaaaugacuggacacucgugaagaccaaaacagaacaggagauugauagaagccgcaagaccguuggcaacuacaucuaugagacgcugcugcagaaccccaagcagaaaauuaagggcaaacucgugcggacaaucgaaagaaaguuuuacaaagaggaacugaagcgcauccuugagaagcaaaaagaauuucaucgggagcuggagucuaaugaccucuauaacgauugcauuagagaacuguaccgcaauaacgaggcccaccagcuuacccuguccaagaaagacuuuguccaucucuucauggaagauaucauuuucuaucagcggccucucaagagccaaaaauccucuaucagcaauuguacacuggaguucagaaaguacaaggacgagaacgggauugaacacacccaguuucugaaagcgaucccgaaguccaaucccuacuaucaggaguuccgcaucuggcaguggauuuuuaaccugaauaucuacaaaaaggauaacgacgacaaugugaccaaagaguuccuuaacacaacgcgggauuuugaaaaucuguucgaauuucucaacaauagaaaggagauugagcaaaaaccucugcugaaguuccuucucgaacagaaggaguucaaaggaaagcugcugaacgccgaaaccgagaaauuucgcuggaacuauguggaagacaagaaauaccccugcaaugagacacggaccaugaucagcgagagacucaagaaggucgaaaacauuucugaugacuuccugacacgggagauggaacagaaaaucuggcacauuaucuauuccguuaaugauaagaccgaguacgaaaaagcucuuaagagcuuugccgagaaaaacaaucuggacgagaacucucucuucgaggcuuuuaagaagcugccucccuucaaaagcgaauauggcuccuuuucugaaaaggccaucaaaaagcugcuuccgcucaugcgccuggggaaauacuggagcuacgcgaagauugaucuguauuccaagaauagaauccagaaaauuaucacgggagaguucgacgagaacauuaaggaucgggugagagaaaaagccauccgccucacagcugagaaugacuuucaaggccugcagcuuuggcuggcccaguacaucguguaugggcggcauagcgaggcuucuaugauuggaaaguggaacuccgccgaugaccucgaagaguuccugaaagaauuuaagcagcacagccugagaaauccuaucgucgagcaagugauuaccgaaacccuucgcaucguuaaagauauuuggcucaaguacggcaacggcgccaaggacuucuuuaaugagauccauaucgaacuggggagagagaugaaacagacaaaggacgaacgggcuaacgcgaccaaaacaauuacggagaaugagaacaccaaccugcgcaucaaggcccuccuggcugaaaugaugaaugaucacucuguggagaacgucagacccuauuccccuaugcagcaggaaauucuuaaaaucuacgaggacggcauucucaagagcgauaucgaaaucgacgaugacauucugaagaucuccaaaacagcccaacccucuagcuccgaucugaagcgguauaaacuguggcuugagcagaaguacaaaucucccuacaccggacagauuaucccucucaauaagcuguucacaccggaguaugaaauugagcacaucauuccccaaagccgcuacuucgacgauuccuuuagcaacaagaucaucugugaaucugccgugaauaaacugaaggacaacuauauugggcucggauucaucaaacaguuuggcgggaccauuaucgagugcggcuucggaaagagaguuaaaguguuugaggucggcgaauacgaggaguucgugaagaagcauuaugcuaauaaccgggggaaacgcaauaagcugcuucuggaagaaauuccugagaaaaugaucgagagacagaugaacgauacgcggcacaucuccaaguacauuagcggaauccucucucauauuguccgcguggaagacggcaccgaugaggggguuaauuccaaaaacgugauccccggaaauggcaagauuacaacccagcugagacaagacugggggcugaacgacgucuggaaugaacuuauccugccucgguuugagagaaugaaccagcucacaaacagcaccgauuucacgucuuggaaugaaaaccaccagaaguaucugcccacagugccgguugaguuuagcaaaggcuucuccaagaaacgcaucgaccaucggcaccacgcccucgaugcgcuggugauugcuugugccaccaaggaccaugucaaucuucugaacaaucagagcgccaaaucugcuacaaagagauacgaucucaaaaagaagcugaugaaauuugagaagaccguguacaaagacccucaaaccgaaaagcgcaucgagcgggaagugcccaaacacuuccugaagccuugggagacauucacgguugaugccaagaacagacuugaaaccauuaucgucuccuuuaaacagaaucugcgcgugauuaacaaggcuacaaauuauuacgagaaauauguggagaaggacggagucaugaugaaagaacggguggagcagaccggcacaaacugggccaucagaaagcccaugcauaaggaaaccguuagcgggaaaauugaucucccuugggugaagguccccaaaggaaagauccugacggcgacacgcaaaucccucgacaccucuuucgaucugaaggccaucgcuagcauuaccgacacaggcauccagaagauucuuaaaaauuaccuggaguuuaaggaguccccggaacucgccuucucuccugaggggaucgaagacaugaacaaaaauauugagaaguauaacggaggccggccccaccaacccaucagcaaagugagaguuuuugaacugggguccaaguuccaggugggccagaccggaaauaaaaaggauaaguacgucgaggcugccaaaggcacaaaccuguuuuucgcgaucuaugaggacaagaaagggaagcggucuuacgaaacgauuccucuuaaugaggugaucgaacgccaaaaacagggacugagcguuguggaucucaagaacgucaacgacuuuuuccugugcccgaaugaucucguguacauucccuccggcgacgaguuugaaaacagagggagcaucgagauugagaauaucaccaaggaaaaaucugagcgguucuauaagguggucuccuuuagcggaucucagaucuucuucguucgccacgauauugccguguccaucgugaacaaaggcgaauuuagcacacugaauaagauggagagagcuauugacgggucuauggucaaagaaaucuguauuaaacuuaagaucgaucggcugggcgacgugcugaaagccuga

SEQ ID NO: 4530 - RNA, 4317 nt, Artificial Sequence
  Cas9 variant
auggugaagaaaggcuacaccaucgggcuggacauuggaacaacgagcgucggcugggccguuaccgaugacgauuucgagcucgugaacaagaaaauguccaucaaggacaaaucugggagcacaauuaagagagugcggaagaaucuguggggaguccgccuuuuugaugaagcuaaaaccgccgagaacacaagacggacccgcggcgugagacggcgcaucagacggcgcaaggaaagacugaauuaucuccaggggauuuucuccucugagauggcgaaaauggacgaaaacuuuuucaugcggcuggaggagagcuuuuucaaacuuuccgauaagucugaacaaaauaaguuucccuacgcucuguucaagaacgagaucgaagagaaagccuauuaccgccaguuuccuacaaucuaucaccucagaaagcaucugauggagcacgaagagagcgaccugcggaaaauuuaccucggacugcaucacauccuuaaguaucgcggccauuucguucaggaaggccagaaaauggauguggccaauauugacauccaagggaaccugaaggagcucuuuaaugcucugaacgaaaauuucuccaacaaagaggaugacuuugagcaggaaagaaugaaggauggagucaagcgggccaaagugcuuuucgacaccgagaagcuggcugccguugaagagauucucaaagaaaagaucagcaaaucuuggaaggugaauaagauuuccaaaggcauccuggcggagaagaaagaccugccgaucuucaaggccauugucgggaacaaaaucgaucucgcuggaauuuuugacugccccgauuacgccgagaaggugaaugaaagcaucaaggagcugaaagacaagguguacuucaacaaagaagauuuugaggaaacguucgagaaacuuucucagcugcucaaggaggaagaacuggaaauucuuauccuggcuagaaaguguuaugaggccguccuccuggcggacaucaugcagggcgagcaaucccugagcgaugccaugguugcuaaguacaacgaccacaaaaaggaucucgugauuuuuaaaaaguucgugaucgacuauuuuucugaagaugucuacuucgaccuguuuaaaaauacccagcuugccgggaacuaucacuccuacgugaagggagagcgcaaaggcaauaaguucaaccaugcuagccuggacgauuuuuauaaguucguuaaaaaggaacucgacaaaaaggccgaggaacuguccgagcacccuguguacaaacagauucuucagaagaucgagcuggaaacauuucuccccaagcaacggauguucaaaaauggcgccauuccuuaccagguccaucugcacgagcugagagcuaucaucaagaaacaggaaaagcgcuuccccuuucucgcggagaaaauuaucauuaaggauaaccaaaaggacaucucugaauauaaaauugagacccugaugaaguuccggaucccuuacuauguggggccgcuuauugaggccagagaaggagagcugggcaaaaagcgcacaaauuacagccgguuugcuuggaugcagaaaucccccgaaagccagaacaucgggaucaccccuuggaauuuccacucuguuguggauaaggacgccuccgccagcgaguuuauugaaagaaugacgggauucugcucuuauuuucccgaggagccuguccuccccaagaacagccugaucuaccagcaauucacaguguuucaggaacuguccauugucggcuauuacgaugagcagaaucgcaaacauuaccuugacggggaaacccggagacgcaucuucgaggaucucuuuaagaaaaaccggacagugucugcuggacugcugagaaaguggcucguuuguaaucagcggaccagccaagaggaaaaagagauucgccuguucggccuugaccugaagaaaaacggccucggguccggaaauuuuaacaccaaguauacaacguaccuggaucugaaggacgccggcaucaccgaaaaacagcuuaagcagcacaaagauuucuucgagaagaucgugaaauaucagacaauuuuugaagacaagaagauccucaaaagacggauuauccugcugaacgaggagcaaccgcuccugagcgaggagcagauuaagaaucuugcgaaaaagcauuacaccggguggggaaaccugucucucaaacugaucgacggcauccaggauaaggggaagacaauucuggacuaucuugaaacccaggauuacaaucaaaaccucaugcagcugaugaaugacgagaacaaauccuucgaaaugcagaucgagcaagcuagagccggcaagguccaguuuggaaaaauugauuauagcuucguggagcagcuggccggcucuccugcuaucaagcgcgggauuuggcagucccuccaaaucguugaggaacugguggccuuucuuggaaaagaaaauaucaagaagauugucaucgagauggcucgggaaaaccagagcuccaaaagaacgaagucucgccagaaacagauugaggcccuguaccaaaaggugacaggcgaccucaaaaaugagcaggaaaagaucgaugugaugcagaacuucgacaaugagagaguuuuucuguacuaucugcagaacgggaagugcaugcacagcggagaaaaacuugagcucucccaacugucugaguacgaaauugaucauaucauuccccagaccuauaucaaggacgauagcuucgacaauaaaguccuggugacccggaacgcgaaucagcaaaagggcggggaugugccuuccuacgacgucaucgacaaaaugaaaagcuauugggagaagcucaaggaaaacaaccugauuucugagaagaaauuugccaaucuuacaaagggcaaauucgaugaccagcagcuguccggauuuaucaaccgccagcucguggaaaccagacaaauuacaaagaauguugcuaucauucuggauaaaaucuacaacgacgaggccaagaaugagaaggaaguggcuaucauuacgcugaaaagcgcccuuaccucucaguaucggcagggcaucauuuacguccccaacgaugacuucgaugagcugaagcucguguccaaaacaaauagccgccugaaggaaguuaaacuccacgacggguucuacaaggugagagagaucaacgauuaucaccaugcgcacgacgccuaccugaauaacgucguggcuaccuaucuuuacgaagccaugcccgaucugcggccucucuuuguuuauggagagcauucucgcgagauucacaagagauuccugggcaaauacgcuacaacccggaaggggcaguuuaaacaacugcuuguggacaugcaggacgaauauuggaugcgcaaggauaaagagggaaauuucaucgacggcgaaauccuguggagacgggaugagguccuccagauugugaagaaggugcuggacuacagaaacauccagauuacgaaaaagcucgaaaugauggucaccgggggcgaggagaaauccuuuuaccaagauagccgcugucggaaggacaaaacagccaucccguauaagaccaauugggaucccagcaaauacggaggcuucaagucuccuagaacagccuaugcuauucccguuaucaagaaaaacaagccuaaacuggaacccgugcuucuggugaaucgcuccaaggucgagaccgacgggcaguuugauugcgaaaaauucaaggagcucaacccgacgcugaagauucugggacagccuaucuggaaauaccagagcuuugagauguucgacggcacaaagcgguauaucgcguccgccucugaaauucacaaagggaaccaaaucaaguuuagccaggagcauaugaaauucauuuccuguugccagaaguacgaugaagugaagaauaaacuugcuuuugacuucguuaacgagucuaagcaccuguuccaagaaauccucaccgccauuaaagauaauauccauagauaucgccugaucgccgagggaauugaggugcaccggaaguuuagcaacaugcucgaaaauaucgagaaacuguccacacaggaacuugucgacaaccugcuggacgcuauuaauaucaccucugugggcaccacaaacaaugccuucgggagaguucgcuacaagggcagcuaccucaacgagauuugguccgcgacgcugauccaucagagcgugaccggacuuuaugaaacacgggagaagcugaucuga

SEQ ID NO: 4531 - RNA, 4323 nt, Artificial Sequence
  Cas9 variant
augaagaccauccugggccucgaccuggggacaaacagcauuggaugggcccuuguggagcaggauuucgaaaauaaacaaggccugauccucgggaugggauccagaauuauccccauggacgcuggcauuaucgggaaguuugccgagggaucuagcaucucccagacggcggaacggaccggcuaccgcucuauuagacggcugcgcgagagacaccuucugcggcgcgaaagacuccaucggguccugaacauccugaaauuccucccugagcacuaugcugccgagauugauuuugaaaagcgcuucggccaguuucuggccgagacagaaccgaaacuugcuuggaaaaagagcgccgaggggaaauucgaguuucuguuccagagauccuuugacgaaaugguugcugauuucaaggccaauggacaagacaucaaaauucccuacgauuggaccaucuauuaccuccggaagaaagcgcugacacagaagauuucuccucaggagcuugccuggaucauccugaacuuuaaucagaagcgcggcuauuaccaacucagaggggaagaggaagaggagaaccccaauaaaaagguggaguucuauagccugaaaauuguggacgucguggcugaugaacagccuaacaagaaaggagacaccugguacucccugcaucucgaaaauggcuggguuuaccggcgcagcucuaagaucccccuguaugauuggaaagacaaggugagagauuuuauugucacaaccgacaucaacgaggacggguccgaaaagcuggauaaagacggagaggugaagcggagcuucagagccccuaaagaggaugacuggacgcugauuaagaaaaagaccgaacaggagaucgaacaguucaaucaaacaguuggcucuuacaucuaugaggcucuccuggauaacccgacccagaagauucgcggcaaacuugugcggacaaucgaaagaaaguuuuacaaauccgagcugaagaaaauucucgagaagcagaucgaacugcaacccgagcuguucaccgaagaccucuauaaugccugcgcgcgcgagcuguaccggagcaacgucgcccaccagcagcagcuuucuuccagagauuuuguguaucuguuccucaaugacauuaucuuuuaccaacgcccucugcggagccagaagucccuuaucucuaacuguagccuggaguucagaacgauuaaagauaaggacgggaacggacagaucauuuaccucaaagcuauccccaaguccaauccuuauuaccaggaauuucgcguguggcaauggcuguauaaccugaaaauuuucacaaaggaggaugacaaggacgucaccaaucaguuuaucaacaaaguugaagaucucgaggcccuguucgaauuucuuaugaaucagaaggaggugaaccauacagacauucugaccuaccucaucgagcccaucgugaaaagcaaguauccgaaugcuaaaggcaaggccuucaaagaugaacugaagaaggagcugaaaaaguaccgguggaacuaugucuacgacgccgauaaagacgaaucuaaguccuacccuaugaaugagaccagauaugaacuucgcaaacggcucgauaagguggagaacguucccgcugacuuuaugacaagaaagauugagcagcaccuguggcacaucauuuacagcgugacggauaaaaucgaguucgaaaaggcgcugaaaucuuucgccaauaaguaugaccuccaucaagagagcuuugucgaaaacuucaaacgguuuaagccuuucgauuccgacuacgggaccuauucugaaaaggcuauuaaaaagcugcuuccccugaugcgcgugggaaaauacuggagcugggagggcaucgauaauaacacaaagaaaagaaucgggaagauuaucaccggagaguaugacgaaacaauuaagaaucggguuagagagaaagccaucgaccucaccgaagagaaccacuuucagggccugcagcuguggcuugcccaguacauuguguacgaucgccauuccgaggcugacaucgccggcaaguggaacagcgucgcggaucucgaacaauaucugucugaguucaaacagcacucccugcggaaucccaucguggaacaggucauuacggagacacucagagugguucgcgacaucuggaagcaauacgggaaaggagcuaaggauuauuuugacgaaauucacaucgagcugggcagagagaugaaaaacaccgccgaggaacggaagcgccuuagcucuauuaucuccgaaaaugagaccacaaaccugagaauccgggccauucucgaggaacugauguacgaugagaauauggaaaacgugcgcccuuauagcccgaugcagcaggaggcucugaagaucuacgaagacgggguccuuuccucuagcguggagauucccgaagauaucgagaaaauuuccaagaaaucugagccuaccaagagcgaaauccagagauauaaacucuggcuggagcaaaaguaccggucccccuacacaggacgcccuauuccccugagcaaacucuucacgccggccuaucagaucgaacauaucauuccucaggcuagauuuuucgacgauggcuuuucuaauaaaguuaucugcgaguccgaggugaacgcccugaaggacaaaaugcuugggcuggaguucauucagaauuacuauggccaaaaggucaccaccagcuuuggagaagugacaauccucacagaagaugcguacaaagccuucgugaaggagcacuaugacaagaaccggucuaaacgcaauaagcugcugcuugaagagauucccgagaaaaugaucgacagacagaugaacgauacccgguacaucuccaaguauauuagcaaaguucucucuaaucuggucagaggcgaaaaggacgaugagggggugaacagcaagaauaucauuccuggaaacggcaaaaucuccgggacgcugaagcaggacuggggacucaacgauguguggaaugaccugauucuuccccgcuucgaacggaugaaccagcugaccaauagcacagauuuuaccgcuuggaacgagaaacaucaaaaguuccucccuacaaucccccuggaacugucuaaaggcuuucagaagaagagaaucgaccaccgccaucacgcccuugaugcucugauuaucgccugugcgacccgggaccacgucaaucuccugaacaauaaacaugccaaguccagaaacgagcgcuacgaucuccagcacaaacugcggcauacgacaccguggcaagacaaggaggggaaagugagaaccaaguucacagaauuuaaaaagccuugggagaccuucacccaggacacaaagaaagaacuugagaagauuguugugagcuuuaaacagaaucugcgcgucaucaacaaggcuacgaauuacuaugaaaagauuguggauggcaagaagguuauguucaaacaggagggagugaacugggccauccggaagcccaugcacaaagagaccgucuccggcaagauugaccuccccagagugaaaguuucuaaggggaagauccugacagcuacccggaaaagccuggauacauccuuuaaugccaagaccauccuuucuauuacggacacaggaauccaaaagauucugcucaacuaccugaaggccaaaggcaauccugaacucgcuuucagcccggaggggaucgaagagaugaaccagaacauuucccuguauaaugauggaaagccccaccagccuauccuuaaggugcgcgucuuugagcagggcucuaaauucccccugggggaaaccggcaacaagaccacaaaauacguggaggcggccaagggaaccaaucucuucuuuggcguguaugaaaacaaucaagggaaaagaagcuacaacacaaucccucugaaucuggucauugagcggcagaagcagggacuuaacuccguucccgaaacgaaugagaaaggccaucgccuucucuucagccugucuccuaacgaccucguguaugugcccaucgagggggaagucuuugauaagaccaauccggacgugaacagaauuuacaagaucguuuccuucagcggaucucagauguuuugcgugcggcaagaugucgcuacauccauuguguacaaacuggaguucagcucucuuaauaagauggaaagaaccaucgacggcaucaugauuaaagagaucuguauuaagcugaaaguugaucgccuggggaacaucuccaaggccuga

SEQ ID NO: 4532 - RNA, 4323 nt, Artificial Sequence
  Cas9 variant
augaagaccauccugggccucgaccuggggacaaacagcauuggaugggcccuuguggagcaggauuucgaaaauaaacaaggccugauccucgggaugggauccagaauuauccccauggacgcuggcauuaucgggaaguuugccgagggaucuagcaucucccagacggcggaacggaccggcuaccgcucuauuagacggcugcgcgagagacaccuucugcggcgcgaaagacuccaucggguccugaacauccugaaauuccucccugagcacuaugcugccgagauugauuuugaaaagcgcuucggccaguuucuggccgagacagaaccgaaacuugcuuggaagaagaaugccgaggggaaauucgaguuucuguuccagcggagcuuugacgaaaugguugcugauuucaaggccaacggacaagacaucaaaauucccuacgauuggaccaucuauuaccucagaaagaaagcgcugacacagaagauuuccccucaggagcuugccuggaucauccugaauuuuaaccagaagcgcggcuauuaccaacucagaggggaagaggaagaggagaaucccaacaaaaagguggaguucuauucucugaaaauuguggacgucguggcugaugaacagccuaauaagaaaggagacaccugguacagccugcaucucgaaaacggcuggguuuaccggcgcuccagcaagaucccccuguaugauuggaaagacaaggugagagauuuuauugucacaaccgacaucaaugaggacgggucugaaaaacuugauaaagacggagaggugaagcgguccuucagagccccuaaagaggaugacuggacgcugauuaagaaaaagaccgaacaggagaucgaacaguucaaccaaacaguuggcagcuacaucuaugaggcucuccuggauaauccgacccagaagauucgcggcaaacuugugcggacaaucgaaagaaaguuuuacaaaucugagcugaagaaaauucucgagaagcagaucgaacugcaacccgagcuguucaccgaagaccucuauaacgccugcgcgcgcgagcuguaccggagaaaugucgcccaccagcagcagcuuuccagccgcgauuuuguguaucuguuccucaacgacauuaucuuuuaccaacggccucugagaucucagaagucccuuaucagcaacuguucccuggaguuccgcacgauuaaagauaaggacgggaauggacagaucauuuaccucaaagcuauccccaagucuaacccuuauuaccaggaauuucggguguggcaauggcuguauaaucugaaaauuuucacaaaggaggaugacaaggacgucaccaaccaguuuaucaauaaaguugaagaucucgaggcccuguucgaauuucuuaugaaccagaaggaggugaaucauacagacauucugaccuaccucaucgagcccaucgugaaaagcaaguauccgaacgcuaaaggcaaggccuucaaagaugaacugaagaaggagcugaaaaaguacagauggaauuaugucuacgacgccgauaaagacgaauccaagagcuacccuaugaacgagacccgcuaugaacuucggaaaagacucgauaagguggagaauguucccgcugacuuuaugacacggaagauugagcagcaccuguggcacaucauuuacucugugacggauaaaaucgaguucgaaaaggcgcugaaauccuucgccaacaaguaugaccuccaucaagagagcuuugucgaaaauuucaaacgcuuuaagccuuucgauucugacuacgggaccuauagcgaaaaggcuauuaaaaagcugcuuccccugaugagagugggaaaauacugguccugggauaucaucgacgacaagacaaaaacccggauuggcaagaucauuacaggggaguaugaugagaccaucaagaacagaguucgcgaaaaagccauugaccucacggaggaaaaucacuuucagggacugcagcuguggcuugcccaguacaucguguacgaucggcauucugaggcugacaucgccggcaaguggaacagcgucgcggaucucgagcaauaucuguccgaguucaaacagcacagccugagaaaccccauuguggaacaggucaucacagaaacccuccgcgugguuagagacauuuggaagcaauacggcaaaggggcuaaggauuauuuugacgagauccacauugaacugggacgggagaugaaaaauaccgccgaggaacgcaagagacuuucuuccaucaucagcgagaacgaaacaaccaaucugcggauucgcgccauccucgaggaacugauguacgaugagaacauggagaaugugagaccuuauucuccgaugcagcaggaagcucugaagauuuacgaggacggcguccuuuccagcuccguggaaauccccgaggauauugaaaagaucucuaagaaaagcgagccuacaaaguccgagauucagcgguauaaacucuggcuggaacaaaaguaccgcucucccuacacggggagaccuaucccccugagcaaacucuucaccccggccuaucagaucgagcauauuaucccucaggcucgguuuuucgacgauggauuuuccaacaaaguuauuugcgaaagcgaggugaaugcccugaaggacaaaaugcuuggccuggaguucauccagaacuacuaugggcaaaaggucacaaccucuuuuggcgaagugacaauucucaccgaggacgcguacaaagccuucgugaaggaacacuaugauaagaaucgcuccaaaagaaacaagcugcugcuugaggaaauccccgagaaaaugaucgaccggcagaugaaugauacgagauacauuagcaaguauaucucuaaaguucucuccaaccugguccgcggagagaaggacgaugaaggcgugaauagcaagaacauuaucccugggaauggaaaaauuaccggcauccugaagcaggacugggggcucaacgauguguggaacgaccugauccuuccccgguucgagagaaugaaucagcugacaaacucuaccgauuuuacagcuuggaaugaaaaacaucaaaaguuccucccuagcgucccccuggagcuguccaaaggauuucagaagaagcgcauugaccaccggcaucacgcccuugaugcucugaucauugccugugcgaccagagaccacgugaaccuccugaauaacaaacaugccaagagccgcaaugaacgguacgaccuccagcacaaacugagacauacgacaccguggcaagauaaggagggcaaaguucgcaccaaguucacagaguuuaaaaagccuugggaaaccuucacccaggacacaaagaaagagcuugaaaagaucguggucaacuuuaaacagaaucugcgggugauuaacaaggcuacgaauuacuaugagaaaaucguugaugggaagaaggugauguucaaacaggaaggcgucaacugggccauuagaaagcccaugcacaaagagaccgugucuggaaagaucgaccucccccggguuaaaguguccaagggcaagauccugacagcuacccgcaaaagccuggauacauccuuuaaugccaagaccauucuuucuaucacggacacagggauucaaaagauccugcucaacuaccugaaggccaaaggaaauccugagcucgcuuucagcccggaaggcauugaggaaaugaaccagaacaucucccuguauaaugaugggaagccccaccagccuauccuuaaggucagaguguuugagcagggaucuaaauucccccugggcgagaccgggaacaagaccacaaaauacguggaagcggccaagggcaccaaucucuucuuuggagucuaugaggacaaccaaggcaaacggagcuacgauacaauuccucugaauaucguuauugaacgccagaagcaggggcugaacuccgugcccgagacgaaugaaaaaggacauagacuucuguucucucucagcccuaacgaccugguguauguccccaucgagggcgagguguuugaugaaaccaauccggacguuaaccggauuuacaagguggucuccuucagcgggucucagauguuuugcgugagacaagauguugcuacauccaucguguacaagcucgaguucagcucucugaauaaaauggaacgcaccaucgacggaauuaugaucaaggagauuuguaucaaacuuaaggucgaccggcugggcaacauuuccaaagccuga

SEQ ID NO: 4533 - RNA, 4332 nt, Artificial Sequence
  Cas9 variant
augaucaagcugcucuaccuggagaaacuuaagcaguauaccaugaaaaagauucugggccucgaccuggggacaagcuccaucggaugggcccuugugaacgaagcugaaaauucugaugaagucagcuccauuaucaaacugggcguuagagugaacccccucacgguggacgagaugcaaaauuucgaaaaggggaagucuauuaccacaaacgccgaucggacccugaaacgcagcaugagacggaaucugcagcgcuacaagcucagacgggacgcgcugaucgagcuucugaaaaaggucggauuuaucacagauaaaaccauucucuccgagcagggcaaccgcacaaccuucgaaacguauagacugcgggcuaaggccgccgaggaagagaucucucuuaaggagcuggcucgcgugcuccugaugauuaauaaaaagagaggguacaaaagcucccggaaggccaaaggagaagaggaaggcgcucugaucgacggcauggagauugccaagaaacucuaugaugaagaccugaccccugggcagcuuugccugcaacuccuggagagcggaaagaaguuuuucccggauuuuuaccgcucugaccuucaggaggaguucaacaaaaucugggauuuucagaagcaguucaaucuguuuuccuucugugacguugcgaaagaggaagugaagggcaaaaacaagagccaaacaugggccauucucgcuaaguauuuugucgagaccaaaaaggugaauguuuggaacgaacacgaggcccagacagagaauagagaagagguguacaaacuggucgggcugaagcggaccgugaaaggagaagaacucaagaaggaaaacuaccgcuggagagugcaggcucugacggagcagcuugaucuggagaaaaucgccgucguucuccaagaaaucaauggccagauuucugcguccagcggguaucugggagccaucucugaccgguccaaggugcuuuacuucaacagacagacagugggccaauaucagauggcugagcugaacaaaaaucccaacaugagccuccgcaauauggucuuuuaccggcaggacuaucuggaugaguucaacgugauuugggagaagcaggccgaguuccauaaagaacugaccccugagcucaagaaggaaaucagagacauuaucaucuuuuaccaacgccggcugaaaucccagaagggccuuauuucuuucugcgaguuugaaaauagagagguuguggucgagaaagaagggaagaaacagacaaagaucauuggauguaaagugaucccccgcagccacccucuguuccaggaguuuaagauuuggcaaacccucaacaauaucgaaguuuucgugggcgagaagaaagggaagcggaaaaaguccaacgucagcucugaucuguuuggagacaccgaagaugcucugaucacagagggcagacgcuuccuuuaucaggaggagaaaaagauucucgccaaggaacuguccaucaaaaaggggcugacgaaagccgaaauucuccggcugcuuuuugagaauccccaggaacuggacaucaacuucaagcagauugauggaaaucaaaccggcuuugcucucuucagcgcguacucuaacaugaucgagaaauacggcuaugagccucuggacuuuaagaagccggccgaagaucugauuagccagcuuaaaacaguguucaccgaccucggguggaauacagaucugcuguucaucgaccucgacaaggagaacaaagaaugggagaagcagcccuacuuuagacuguggcaucuucuguauuccuucgagggagauaauaccccuacgggcaacgggaaacucaucgaaaagauuaugcagcugugcggaaucgagaaggaauacgcuauugagcuggccaacgucucucuucaagacgauuauggcagccucuccgccaaagcuaucaagaaaauucugcuguaccucaaggaagggaaucaguaugacauggccugugaguacgcgggcuaccgccacagcaaaucuucccugacaaaggaggaaaucgagaacaaagugcuuaaggauaagcuggaaauccuccccaaaaauagccugcggaacccuguuguggagaagauucugaaucagauggucaacgugaucaauaccguuauggaaguguauggaagacccgacgagauucgggucgagcuugcucgcgaacucaaaaagucugccaaagagagagaggaacugaccaaggccguggcuaagaacacacgggaacaugaggagaucagaaaagugcugcaauccgaauuuggcaugauuaauguuagccgcaacgauaucauccgguacaagcucuaugaggaacugaaagacaauggguacaagacccuuuauuccaaccaguacauuccgagagagaaacuguucucuaaggagaucgauauugaacacaucauuccucagagccgccucuuugacgauucccugucuaauaagacacuggaguauaaaagcaucaacaucgaaaagggaaauaaaacggccuacgacuucgucaaggagaaauacggcgaagaggggcuucagcaauaucugaacagaugcgagaaccucuguaaggauaagaaagcuaagcugcggaaacucaagauggaacugaaugagauucccgacggauuuaucgaccgcgaucuuagaaacacccaguacauugccaaaaaggcgcuguccaugcucacagaaaucugccggcgcgugguggccaccacaggcagcauuaccgacaagcugagagaggauuggcagcuggucgacgugaugaaagaacuuaaucugccuaaguaugaggcucucgggcugguugagguguacgaagauaaagacggccggaagaucaaacgcauuaaggauuggacgaaaagaaacgaccaccggcaucacgccauggaugcucucaccgucgccuucacaaaggacguguuuauccaguauuucaauaacaagaaugcggccugggagucugauuccaaagaacauaccaacaucguuggaauuaagacacgcuacuuugagagcggcaaagcugugccucccaucccccuggggcaauucagagucgaagccaagugucaccuugagaaucugcucgugucuauuaaagcuaagaacaagguugugaccacgaaugucaacugcaucaaaaagaaaggaggcacauauaagaauacccagcagacaccgcgggggcagcugcaccuggagaccauuuacggaucccauaaccaauacgugaccaaaaucgaaaaggugaaugccagcuuugacgccgucaagaucgcuacaguuucuaaacaggauuauagaaacgcgcuucugaagcgccucgagguguucggcaacgaccccaaaaaggccuucacggggaaaaauagccuggaaaagaacccuauuuaccucgaccgggcucagaccauccaagugcccgauaagguccagacaguggagcuggagaccgccuauacaauuagaaaaccuguugaccccacccuuaauguggauaaggucguggacaaaaagauccgccugauucuggaacagcggcucaaagaguacggcggagaugccaagaaggcuuuuguuaaccuggacgaaaauccgaucuggcuuaacgaggaaaaaggcaucuccauuaagagagugacgauccgcgggauuagcaaagcccaggcgcugcacgauaagaaagacaaggauggaaauuucauccucgacgagacaggcaaacggauuccugucgauuuugugaacaccgggaauaaccaucacguugcuaucuauagaaagcccgugcuggacaagaaaggacaagucauuuucgacgaugagggcaauccuauguacgaacucgacgaggauguggugcccuuuuucgaagccgucacccgcgccaaccuggggaucccuaucauugacaaggauuauaaaaagucugagggcuggcaguuucuuuucuccaugaaacagaaugaauacuuuguuuuccccaacgagaagacaggauuuaauccgaaggagguggaccugcuggauccugacaacuacgcuaugaucagccccaaucucuuccgggugcagaaaauuggccugaacgauuauaccuucagacaucaccuugaaacaacgauccaaaacgaccugaaguuuauuaccuggauccggugugggaaauccggaaucaaggauauugucaaagugcgcaucaaucacauuggccagaucguuucugugggggaguacuga

SEQ ID NO: 4534 - RNA, 4332 nt, Artificial Sequence
  Cas9 variant
augaagaaaauccugggccucgaccuggggaccgccagcauuggauccgcuuacgugcuugaggccgaaaagucugcggaucagacaaaaaucgucuaucugggcacgagaauuauccucagcuccgcugacgccgagaacuucucuaaggggcugagcugcucccccaccacagaucggaccuuuaaacgcucuaugagacggcgccuucaaagauacaagcagcggcgcagcucccugauucagcaguucaagaaaaucggaaucauuacaaauaccgaacaaaucauuagagagccuaucagcgaaacacacgagcuccugcggauucgcucuaaggccguuuccgagcaugugagccuggaagaguuugcuagaauccuccugaccauuaacaaacggcgcggcuauaagucuaauagaaaaacguccaagagcaccgaagaggacgggaaacuuguggaugccauggcugucacaaaggagcugaucaagcucaaaaagaccccgggacaguacauguucgaacgguuuaaacgcggcaaguaugccgagaucgacuucuaccccuuugaucugauuaacgaacuuaaacagaucugggaggugcagggccaaaaguauccugacguucugacagaagggcuccugucuucccugcucaagcagaaaaccggaaaggcgaaagagcugauuuacagcaaguccgaucuuaaucccgccgaggugccuaucgacuaccagaaaggcaagaagcugagaaaaacgauucucaacaaguauuucgcuuacgaaucucggagccuggccgucacaaauaucauccccguggagcaggcuauuaccgccaucguugcgauuuguaaacaaaucaacaauuccagcggguaucuuggagccauuggcgauagaucucgcgugcuguacgcuaacaaucagacaaucgggcaguaucucuacgaacggaucaaggccaacccucacgaccggauucgcggagaggucuuuuaucggcaagauuaccuggacgaguucgacagaaucugggaaugccagcagaauuacuauccggcuauucugaccaacgaucgcaaacaguacauccggaauagaauuaucuuuuaucaacgcccccucaaguccaagaaaagcgagcuggccuucugugaauuugagucucgggaaguggagcauaacggcaagaaauacaccgaaggccuucacguggccccuaagagcucccccgucuuccagcauuucagacuguggcagcgccucgggcagauugagguuucuccucugcggaaaugggacaagcaaagcaacgagcuuuuugaacagcagaauaacgcugauagagagggaauccugaauacagaagcgaagcagaaacucuucuccuaucugaaccugcucgaccaccugacggauaaugagauccuuaacauucugggcuacagccccgacaaguggaaaaucaauuuucgggagauuaucgggaaccgcaccaauaaccucaugaugaaggccuucuuuucuaugaaagaaaugacagauggagagcaaauugacugggaaaagaaucugaccaaaaucacaaacggccagucccugaucagcccggagcagauuguggaucuuaucagacaguucuuugaacgggaggggauuaccacgucucuccuguauuucgacccugcuacagauaauuuuagagagcaaucccacuacagccuguggcaucuccuguacuccuaugaagacgacaacucucccaccggaaccacaagccuuugcaagacccuggccaagcgcuacggcaucccucacgagcucuguccccugcuggccucccuuacauucgaacggcaguauggcucucucagcacgaaagcuaugagaaagcugcugcccuuuaugcaggagaaacgcuacgaugaagccugcgagcucgcgggguauagacauuccgcuuggauuaccaaggaggaaaaugccaaacggacacugaagaacaaacuuccucugcuccgcaagggaagccugagaaacccgguggucgagaagauccugaaucaaaugacccacgugaucaacacacacauugccgaauacggcaaucccgacgagauccggauugaaauggcucgcgauaugcaggccaacucuaaacagagaaaggcuaugaccgccgcgaucacggaggccaccaaacggaauacacaguucauugaggaaauccaaaaggaguuuggguucaacccuuccaagaaugaccuuaucaaauauaagcucuggaaagaacuggcuccccugggaaacaagacccucuacagcaauauuuacaucccuaaagaggagcuguucacagccaaguuugaaauugagcauaucauuccccgcgcucuuuucuaugaugacucuuuuuccaacaagacccuggaacucaauagcguuaacaaacugaagggcaauaaaacggcccuggauuaccuugacacacucgggcaggagaaggcgaacgauuauauccugagaguggaggaacugaaaaagauuggcgccaucacccaggcuaaauacaagaagcuccugauccgggagaaagaccuuggagaugacuucacaaaucgcgaucugaccaacaccagauauauuauccggcacgccgcugacagagaccucacaaacacgcgcuacauuauccggcaugccgccgauaugcugcugcaggucaccccgucuauugugcacacaaauggcagcaucaccgcuauccuuagacgcgacugggggcugcucgauauucugaaggaacucaaccugccuacauaugaguccaucgaccggaaaauuagcgaucccgaagagaaacuuacccaaucuguugacagaaaggauggacaggcgaucaagaugauuaaggacugguccaaacgcgaugaccaucggcaccacgccauggaugcucugaucacggcccucacaaccagaaagcaugugcaguaccugaauggcaacagcggggccgaagagaccgacaaagcucagaagcuggagcaacuuaaagcccugcgcaagcagcucaucggauccgauggccacuuuauuccucccaugcaugacauccggguccaggcgaaggaagcucugucuagagugauuaucagcacaaaagucaaggggaaagugaccacaccuaauacgaacauuaucuguucccgggacaagaccacaggccgcaaaauuuacguuagacaaaccacacucacccccagaggagcccugcaccuugauacgaaguauggcaucaaucgcuacuaucaggagagagaagugucuaucgggagcaagcugacccaggaggaaauucggcucgucuccucuccgcacauccagagcauucugcuggagagacuucgcgccuucgacaacaauccuaaauccgcuuuuacaggacggaacagcguggauaagaaaccccuggaggacaagaauaaaaagcucguuuacaccgauaagaaagugaagcaaacaauccuggccaacagauucgucaaacgcgaccggguuaauucuaagcucgaucuggacaacgugauugauaccggcaucaaaagaauccuugaacgccggcugaagcaguaugggggaaaauacgagacagcguuuuccgaccuggaaaauaaccccauuuggcucaacgaggagaagggcaucgcuauuaagagcgugagaauccgcgggaaaaauaacaccauuacgaucagacagacaaauaccugccggaucaaguaugucgccaacgauaauaaccaucaccuggccguguacgcccuuccugacggcucuauuaaagacgauaucguguccuucuuugacgcugucgaacgcagcagaaagcggcugccgauuaucgauaaacauaagaaucagucucucggauggaaguaccuguucuccauuaaacaaaacgaguauuuucuccugccccaacagguggaaaagaucgacauugauaccggcgagaucagcaugcagacaaccuucuccccuaaagaccuuagccacgaauacaucaugaaucccgauaacuaugcugagcuggccucucauauuuuccgcguucagagcaucuccaagacgccucaggggaauagagacgugcggauuuaccuguuuaaacagcaguauaucucuggaagccaaaaggauucccuccaccugaagggcauuacacacagacagaucucuagcgcgaaagaccuugccgagcuggucaagauccgcgugaaccaucucgggcggauuguuuccgugggagaaaaauga

SEQ ID NO: 4535 - RNA, 4341 nt, Artificial Sequence
  Cas9 variant
auggugaagaacauccugggccucgaccuggggaccaauagcgucggaugggcccuuauuaaacaggauuucgagaacaagcaaggcgacauccuggggaugggauccagaauuauccccaugucucaggauguucucggcgacuuugggaaaggaaauagcauuucccagacagcugaacggacgaaguaccgcucugugagacggcugcgcgagagauuccuucugcggcgcgaaagacuccaccgggugcugaacguccuggauuuucucccugagcauuaugccagccagaucgacuucaauaaacgcuuuggcaaguucaaggaagagaccgagccgaaacuggcguacuccaacgauggcuuuaucuucaagaaaucuuuugaagagaugauuagcgacuucaagacacaccaacccgaacuucuggagaauaacaaaaaggugccuuaugauuggaccaucuacuaucucagaaauaaggcucugucccauaaaauugagaaggaagaacuugccuggauccugcucaacuuuaaucagaaacggggguacuaucagcugcgcggagaagaggaagaggagaaccccaauaagcugauugaguucuacagccucaaaaucguugacgugcuggccgaugagccucagaagggcaaaucugacauuugguacucccuuauccuggaaaacggguggaucuauagacggagcucuaagauuccccuccuggauuggaagggaaaaacacgcgacuuuaucgucaccacagaccuuaaugaugacggcuccgugaagaccgauaaagaggggaacgaaaagcggagcuucagagcuccuggagagaacgacuggacgcugguuaaaaagaagaccgagcaagaaauugauaauucugacaaaacagugggcgccuacaucuaugaggcucuccugcagaacccgaagcagaaaauuaagggcaaacuggucagaaccaucgaacgcaaguucuacaaggccgagcucaaacagauccuggaaaagcaaauggaguuucaccccgagcuucggcaggaugaccuguauuccgauugcgugagagaacucuacaaaaauaacgaggcgcaucagcugacacuuagcaagaaagacuucgugcaccuguuuauggaagauauuaucuucuaucaacgcccucuccggucccagaagucuagcauuuccaauuguacccuggaguuuagaaaguacaaagacgagaacgggacggaacacauccaguaccugaaggcccuccccaaaagcaauccuuauuaccaggaguuccgcauuuggcaauggauguauaaccugaauaucuacaagaaagaagacgauacaaacgucaccaaggaguuucuuaauucuaaagcugacuucgaaucccuguuugaguuccucaacaauaagaaggagguugaucagaaagcccugcugaagcauuuuaaaaucaacgacaagacacaccgguggaaauauguggaagauaagaaguaccccugcaaugagaccaaaaccaugauuagcgaaagacuuaagaaaguggagaacaucucugacgauuuccucacacgcgaaauggagcagaagauuuggcauaucauuuauagcgucaacgacaaagugaaguacgagaaggcucugaaauccuuugccgaaaagaauaaccuggaugagucuagcuucuucgaagcguuuaaaaaguucccgccuuuuaaauccgaguacggagccuucagcgaaaaggcuaucaagaaacuccugccccuuaugcggcugggcaaguauugggacgaugacgagauucucaaauacucugauaucuauuuuaagaauaucgaguaccugcuggggguucuuaaacagaaggacaaaaacauuuccgacgauaauagacaaaacuggaauaagagcaucaacaauaagcuccgcgaagaacuggaaauuuuccagaacgccgagaucgagucuuuucagggacugcggcuccacauugcucaguauauccuguacggcagacacuccgaagccgccaugcuugggaaauggaauagcgcugacgaucuggaggaguuccucaaggaguuuaaacaacauucccugcggaacccuaucguggaacaggucauuacggagacccugcgcgugguuaaggacaucugggugaaauauggaaauggcgcgaaggauuucuuuaacgagauucacaucgaacuuggcagagagaugaagcuccccgccgaagaccggaaaaagauuacaaaucagaucucugagaacgaaaacaccaaucugagaaucaaagcucugcucgccgagaugauggucgauagcuccguggagaacguccgccccuucucuccuaugcagcaagaaauucugaagaucuacgaggacggggugcuuaauagcgauauugaaaucgaggacgauauucugaaaaucuccaagacagcccagccgagccccucugaccucaagcgguacaaacuguggcuggaacagaaguauaaauccccuuacaccggacaaaucauuccccuuaacaagcucuuuacgccugaguaugagaucgaacauauuaucccccagagcagauacuucgaugacucuuucuccaauaaaguuauuugugaggcugccgugaacaagcugaaggacaauuuuaucggccugggguucauuaaacaguuuggaggcacaaucgucgaaugcgggaacggcaagagcgugaccguucucaaagaggaucaguaugaggacuucgugaagaaacacuacgcgaauaaccgcucuaagagaaauaagcugcuucuggaagauaucccggagaaaaugauugaacggcaaaugaacgacacccgcuauaucagcaaguacauuuccggaguccucagcaauaucgugagaacagaggauggcaccgacgauggggugaacucuaaaaauauuguuccuggaaacggcaagaucacaaacacgcugaaacaggacugggggcugaaugauaucuggaacgaccuuauucugccccgguuugaacgcaugaaucagcucaccaacuccacagauuucaccgcuuggaaugagaaccaucagaaguuucugccuacaguccccguggaguucagcaaaggauuuuccaagaagagaaucgaccaccggcaccaugcccucgacgcccuggugauugcuugugccaccaaagaucacgucaaucuucugaacaaucaaucugcuaagagcgacacgaaacgccaugaucucaagagaaaacugaugaaguucgaaaagguggccuacaaccacccucagaccggcgagcggaucgaacgcgagguucccaaacaguuucugaagccgugggaaacauucaccguggaggcgaaaaaugggcuugagacaauuaucgucuccuucaagcagaaccugagagugaucaauaaagccaccaaccacuaugaaaaguacguugagaaggacggcgcuaaagugaagggacgggucgaacaagccggcacgaauugggcuauuagaaaaccuaugcauaaggagacagugucugggaaaaucgaucucccccgcauuaagguucccaagggaaaaauccugaccgccacacggaagaaccucgacaccagcuuugaucugaaaaccauuggcuccaucacagacacggggauucagaagauccuuaaaaauuaucugcaguacaaggauaacaacccugaacucgcguucucuccggagggaaucgaggacaugaauaaaaacauugaaaaguuuaaugauggcaaggugcaccaacccaucauuaaagucagaaucuucgagcuggggagcaaguuuccucugggccaguccggaaacaaaaaggacaaauauguggaagccgcuaagggcaccaaucuuuucuuugccguguacgaggauaagaacgggaaacgcagcuaugagacaauuccccugaaugaagucaucgagcggcagaagcagggacucaccguuguggaccugaaaggcgugaacgacuucuaccucucuccuaaugaucuggucuacgugcccuccgaagacgagcuugaaaacguuagcaugaucgauuauaauaagcugucuaacgagaaaguguacaaggucguguccuuuacagggaaucaaauuuucuuuguuagacaggacguggcuaccagcaucgucaacaaggccgaguucucuucccugaauaaaauggaacgcgccauuggaggcacgaugaucaaggagguguuuguuaaaauuaagaucgaucggcucgggaacaucagcaaaguguga

SEQ ID NO: 4536 - RNA, 4347 nt, Artificial Sequence
  Cas9 variant
augaagcacauccugggccucgaccuggggaccaacagcauuggaugggccguggucaaagaggcucagaaugauaacgaacaauccgagaucguugacgugggcgugagagucaauccccuuacaacggaugaaaagaccaacuucgagaaagggaagccuauuucuacaaaugccgaccggacccugaaacgcagcgcgagacggaaccuccagcgcuacaagcugagacggaaggaacuuaucgagcugcucaaagagcaucagcugauuuccgaaaauacaauccugaccgagaacggaaagggcacaaccuuucagacgcucgaacugcgcgcuaaaucugccaaggagaaaaucagccuuggggagcuggccagaguguuccucaccauuaauaagaagcggggauauaaauccucucgcaaggcuaaaaacggcgaugaaggccaacugaucgacgggauggagauugccaagagacuuuacgaagagaaucugacaaccggacagcucagccugcagcugcucaaagaaggcaagaaaucccugccggauuauuaccggagcgaccuucaguuugagcuggauaagguuuggaacuuccaaaagcagucucacuccgacauccucacagaugaguuuuaugcucagcugaaagggaagggacagcgcgccaccagcgcgcuuuuccuggccaaauaccaaauuuauacggcugaaaauaagggcucuagagaggacaaaaagcuccaggccuaccaguggcggguggaugcucuguccaaggaacugacacgcgaggaacucgccuuugucaucaccgagauuaacaauaaccugaacaauagcucuggguaccuuggagcgaucuccgacagaagcaaagagcuguauuucaacaaugaaacagugggcgaguaccucuggaagcaaaucgccgcuaacccccauaauucccugaaaaaccagguuuucuaucggcaggacuaccuugaugaauuugagcagauuuggaagacccaaucugccuuuuauccugaaauccugaccgacgagcucaaaaaggagcugagagauguggucauuuucuaccagcgcaagcugaaaagccagaagucccucgugagcuuuugcgaguucgagaauaaagaaaucgagauuaagaacgaggacggcacaacgaccaaaaaggugaucgggcugaaggucgcucccaaaucuuccccucuuuuccaggaauuuaagaucuggcaaaaucugaacaauguucucauucggaaaaagggaagcaaaacaaagaaaguggccaagaaccagcaggccgugcuguucgaggaagagaagaccaucucugaacuggaucuugaggcuaaacaggcgcucuuuaaugagcugaaccugaagggcaaucucaaagccgacuauugucuggaaauucuuggguacagccccaaggagugggaaaugaacuacuccauccuggagggaaacagaacaaauaaagcucucuaugaagccuaccugaagauuaccgaucuggagggcuaugacgccaagaaccaccuuaaagucaagcucaauaaagaugagguggaacuggacgaucugaagguuccugcuucugagaucaaagacauggugcaagccaucuucaaggaagcggggauuaacacggacauccuccauuuuaaugcugagcuggauggaaaggacuucgaaaaccaggccagcuaccagcuuuggcaucugcucuauuccuacgagggcgaugacagcaaaucuggcaaugagcugcuguauaaacuucucgaaacaaaauuuggguucaagaaagaguacgcccagauucuggcuaacgucucccugagcgaugacuacggaaaucucucuaccaaggccaugcgcgaaaucauuacccaccugaagcaaggcuuuccguucacagggcggaaagauagacccgacgagccuuccgcuugcgaguuugccggauauaagcacagcaaacacucccuuaccaaggaagagaacgaaaaacgcgugcugaaggauucucucgagguucugaaaaagaauagccugcggcagcccguggucgaaaagauccuuaaccagaugauuaaucucgugaacgcgcugcugaaaaaguacagaacagagaauccuaacuucaaauuugacgagauccgcaucgaacucgcccgggagcugaagaaaaaggcugaagagagagccaacaugacggcuaauauuaacaaggccaaaaccgaacaugagaagaucauuaaaauccuuaagaaugaguucggccugcccaacccgacacgcaaugauauuauccgguauagacucuacgaggaacugaaagacaacggguauaaggaucuguacaagggcgacuauaucccucgggaaaaacuuuucuccaaggagauugacaucgaacacauuauccccaaagcgcgcgucuuugaugacucuuucagcaauaagaccauuacauacagaaaaaccaaccuggagaagggagagcggacggccuacgauuauaucgaaucccucggcgagaagcaacuggaagaguuucucagcagaaucgagaaucuguacgaaauugggaaaccuucucgccuucacaaccggagaaauccccugaagaaaguggaggaaaagggaaucuccgacagcaaauauaagaagcuccugaaaaaggagucugaaauuggcgauggguucguugagcgcgaccugagagagacccaguacaucgcuaaaaaggccaaagaaauucuucugcagaucacacgguccgugcucagcaccucuggaggcaucacagaucgccugagagaggacugggaucucauuaacgucaugaaggaacugaaucuucccaaauaucgggcucuggggcucaccaagauggaggaccgcaaguacggccagcaaguggaaguuaucacggauuggacaaaaagaaacgaccugcggcaucacgccauggaugcccugaccguggcuuuuacaaagcauaaucacauucaguaucuuaacuaccugaacgcgcgcaaaaaugagaagcauaaagagcacaacaauaucauggccauucagcagcucgaaaccaucaaggucaccgacgagaacggaaaugaaaagagaauuuucaaagcuccuaugccgaacuuucggcaaguggccaaggccuuccuggagaaugugcucaucagccacaaagcuaagaacaaaguugucacaaagaauaagaacaaaaucuccggcaauaacaaggugcaggaagugcugacgccccgcgggcagcuucauaaagagaccauuuacggaaaguaucaguacuauguccaaaaagaggaaaagaucggcgggaaguuugaccuggagacaauugaaaaaguggccaauccucuguaccagagccuccugaagaaaagacuugaggagaacggaggcgaucccaagaaagcguucaccgggaaaaauucucuggcuaagaacccuaucuaucucgacgaagcccagacagagcaacugcccgaaaagguuaagcucguguggcuggaaaauuccuuuagcauucggaaagauaucaccccggaaaacuucaaggacgagaaacuuaucgauaagauucuggacgagggcgucaaaagaauccugaaggaacgccuccaguccuuuggaaacgaugccaagaaggcuuucucugaccuggagaagaauccuauuuggcuuaacaaagaaaagggcaucgccauuaaacgggugacgaucagcgggguugcgaaugcugagccccugcacacaaagaaggaucaucucggaaaagaaauccuggacaaggagggcaaaccuauucccguggauuucaucuccaccgggucuaaccaccacgucgccguguacagagacgagaagggaaaucuccaggaaaaaguugugagcgucuuugaggccguggugcgcgcuaaccagggccugccuauuaucgacaagaccuauaaucaauaccuugggugggaguuccuguuuuccaugaagcagaacgaaauguucgucuuucccaaugaaucuacaggcuucaacccgaaugauauugaccugcucgauccuaaaaacaagaaaaucauuagccccaaucuguuucggguucagaaacuugccaccggagacuacugguucagacaucaccuggagacaacgguggagaccaaguccgcuacaaaggauaugaccuauaaacgccucagccugaaccauaucaagaauaucauuaaggugcggaucaaccaccucggcgacauugucucugugggggaauacuga

SEQ ID NO: 4537 - RNA, 4353 nt, Artificial Sequence
  Cas9 variant
augaagcacauccugggccucgaccuggggagcaacuccauuggaugggccuucgugcagcaagauuuugagaauaaacagggcaagaucauugcuaccgggucuagaaucauucccauggaccagggaauccuuggcgauuucgaacgggggaacacagucagccagacggccgagcgcaccacauacagaaauacccggcgccugagagaacggcaucuccugcgcagagagcggcuucaccgcguucugcauauccucggauuucugccuccgcacuaugacucccaaauugauuucacaaaaagauacggcaaguuuaucgacaacgcggaacccaaaauugcuuauaauaacggcaauuucaucuuuaugaacucuuucaaugagaugauugaggauuuuaagaaguaccagccucagcuguucuauaaaaagagcaacggggaagaguccaaaauccccuacgacuggaccauuuauuaccuccggaagaaagcccugucucagaagaucacacaacaggaacuugccuggcugauccuccauuuuaaucagaagcgcggauacuaucagcugagaggcgaggaggaaaccgagaacccuaauaaagaaguggcuuuccacagccuugagguggucgauguggaagccgaggcucccaacaagaaaggggagauuugguacacgauccggcuggaaaauggauggauuuaucgcagaaccuccaagaucccucucgacgauuggaaaggcaagacacgggacuuuauuguuaccacagaucugaacgacgacgggaccaucaaacuggauaaggagggaaaggaaaaacgcagcuucagagccccggacgagaacgauuggaaucuccugaagaaaaagacggaacacgacaucgauuucucuggcaaaacagugggcgcguacauuuaugaccaucuucugcaaaaccccaaucagaagaucaaggggaaacucguccggaccauugagagaaaguacuauaaagaugagcugaaggccauccuugcuaaacagauugcccugcaaccugaacucuuuacagagacccugcuggcugacugcauccgcgaacucuaccggaagaacgagacccagcagcagaaucugcuuuccaaggauuuccugcaccucuuuguggaagacaucauuuucuaccaaagaccccugcgcagcaaaaagucuacaaucgccaacuguacgcuugagaaacgguccuauauugauaaggagaccaaugaaagaaaagacacaccuaucaagguuugcgcuaagagcaaccccuacuaucaggaguuucgcgugcugcaguggcuccagaaucugcggauuuacgaaaucgagaccgacagagaggucacagccgaguucauugaaaccgcucaagauaacgaagcccuguuuaauuuccucaugucucagaaagagaucgacaacgaaucccugcuuaaguauuuucuguucgcuaaaaauccgcagaucaaggauaaaguggccaagagcgagcucaaaaaguggcugacgacauaccgcuggaacuauguguacgacgccgcugauaauuccucuaagaaauacccuaugaacgagaccggauaugaacugcagcaauaccuucagaaggucgagggccuccccgcgaacuuucugaccuucgacauuacauaucggcuguggcaucuccuguacagcguuaaagauaagguggaauuugagaaagcccuuaagaaguucgcucaggaauaucagcuggacgaggccuccuucguggauagcuuuaaaaauuucaagccuuaccccaacgaguaugggucuuuuuccgaaaaagccaucaagaaacuccugccccugaugagauucggaaaucacugggacuuuaaccggauugaugucagcacccaaaagcgcaucgacgaucuuauuaauggcguggcuaacgacgagaucagaacaaucauucgggaaaaggccgagaaauaccagcucaauucugaaacguguuuccaggggcugccucuguggcucgcgcaauacguuguguauaacagacacgcugaggccgccgacaucgagaaguggaccagcgucaaugaucuggaagcguaccuugaggacuuuaaacagcauucccugcgcaacccgauuguggaacagguuaucacagagacccuccggguggucagagauauuuggcagcgcuauggaggcggccaagccaauuucuuugacgagauccacaucgaacuggggagagagcugaagaaaacagcugaggaacggaagcagcuuucuaaccgcaaucaggaaaacgagaauaccaaccucagaauuaagaaacugcuggccgagcucaaggaagaugcgagcauccagaacgugcggcccuacuccccuguccaacaggagcugcuuaaaauuuaugaagagggaguguucagcgccacggacgaaguugaggaggauauccagaagauucgcaaaaaggcugaacccaccacaccugagauccagagauacaaacuguggcucgaacaaaaguauaagucucccuacaccggcgaggugaucucccugacaaaacuguuuaccgaagaguacgagauugaacauaucauuccgcagagccgguauuacgacgauucucuuuccaauaaggucaucugcgagagcgccgugaacaaacucaagacgaaucagcuggggcuggaguucauucaaaaccaccauggagaaaaaguucgcaucacagcuaauaaggaggugaccauuuuuacagaggaacaguauaaggaguucgucaaaaagcacuacgccaacaauuccgcgaaacagcagaagcuccugcuuaacgaaaucccugagaaaaugguggccagacaacugaaugacacccgguauaucucuaaguacauuagcgaaauccucuccaagauugugcgcucugaugagaaagacgaaggcguuaacagcaagaauaucauucccuguaccgggaaaaucacaacggcucugaagcaggauuggggccugaacgacgucuggaaugagcuuauccugccuagauucgaacggaugaaccagcucacccagacacaacuguuuaccuccuauaaugacagauuccagaaaaaccuccccacagugccuauugaguacagccagggauuucagaagaagcgcaucgaucaccggcaucacgccauggacgcucuggugauugccugcgccaccagagaacauaucaacuacaugaauaaccaacacgcucuugauaaaucuaaggacaaaaaggagaaacagcagucccgcauugaucugcggacgauccucugugagaagaagaauaacaauuggcaguucaaaaagcccuggagcacauuuacccaagaagcgcaggaggcccuggaacacaucgucgugucuuucaaacagaaccugagaguuauuaauaaggcuaccaacuauuacgagaaaugggaagagaagaauggcgugcuugucaaaaagaaggugaaacaagaggggacaaacugggccauccgcaagccgcugcauaaagaaaccguuuccggaaagauugugcucgaccggaaaaucggcaaggauaagauucugacagccacgagaaaaagcgucgacaucaccuuuacagagaagauuaucucuagcaucaccgauacagggauucagaaaauccuccugaauuaucuuaaguacaaaggauccccugaaguggcuuucagcgccgagggccuggaggaacucaacaagaauauugcgcaguauaacgacgggaagaaacaccagcccaucuacaagguucgcauuuuugaggaaggcucuaaauucccccugggagagaccggcgcuaaggccacgaaauauguggaagccgcuaaggggaccaaucuguuuuucggagucuaccaaggcaaggggaaacggacauacgccaccaucccucuuaacgaggugaucgagagacagaagcagggacugccguccgugcccgaacggaaugagaaaggcgaaccucuccuguucagccucucccccaacgaucuggucuauguuccuauggagggggaaauugcggagacaaucgacuuuaacaaucuuucuaaggagcagaaagaacgcauuuacaagaccgugagcuucacaggcaaccaaugcuuuuucgugcaggaggcugucgccacccccaucgugaauaaaauugaauauuccccucugaacaagauggagagagacauccugggaacgaugaucaaggaaguuuguauuaaacucaagguggaucggcugggcaauaucacaaaagccuga

SEQ ID NO: 4538 - RNA, 4353 nt, Artificial Sequence
  Cas9 variant
augaagagaauccugggccucgaccuggggagcaacuccauuggaugggccuucguggagcaggauuuugaaaauaaacaaggcaagaucauugcuaccgggucucggaucauucccauggaccagggaauccuuggcgauuucgagaaagggaacacagucagccagacggccgaacgcaccacauacagauccaugcggcgccugagagagcggcaccuccugcgcagagaacggcuucaucgcguucugcacauccucggauuucugccuccgcauuaugacgcgcagauugauuucaccaagagauacggcaaauuuaucgacaaugcugagcccaagauugccuauaacaauggcaacuucaucuuuaugaauagcuucaacgagaugauugaagauuuuaagaaauaccaaccucagcuguucuauaagaaaagcaauggggaggaauccaagauccccuacgacuggacaauuuauuaccuccggaaaaaggugcugucucagaagaucacccagcaagagcuugccuggcugauccuccacuuuaaccagaaacgcggauacuaucagcugagaggcgaggaagagacagaaaauccuaacaaggagguggcuuuccauagccuuaaagucguggauguugaagccgaggcucccaauaagaaaggggagauuugguacaccauccggcuggaaaacggauggauuuaucgcagaacguccaagaucccucucgacgauuggaaaggcaagacccgggacuuuauugugacaaccgaucugaaugacgacgggacaaucaaggucgauaaagagggaaaggaaaaacgcagcuucagagccccggacgagaacgauuggaaccugcucaagaaaaagaccgaacacgacaucgauuucucuggcaagacggugggcgcguacauuuaugaccaucugcuucagaaucccaaccagaaaaucaaggggaaacugguucggacaauugagagaaaguacuauaaagaugagcucaaggccauccuggcuaagcagauugcccuucagccugaacuguuuaccgagacacuccuggcugacugcauccgcgaacuguaccggaaaaaugagacccaacagcagaaccuccuguccaaggauuuccuucaccuguuuguggaagacaucauuuucuaccagagaccccuccgcagcaaaaagucuaccaucgccaauuguacacuggagaaacgguccuauauugauaaggagacgaacgaaagaaaggacaccuuuaucaaagucugcgccaagagcaauccuuacuaucaagaguuccgcgugcuucaguggcugcagaaccuccggauuuacgaaaucgagacagacagagaggugaccgcggaauuuauugagacagcugaagauuaugaggcccuguucaauuuucugaugucucagaaagaaaucgacaacgagggacuccugaaguacuuccuuuuugcuaaaaauccccaaaucaaggauaaagucgccaaguccgagcugaagaaauggcucaccacguaucgcuggaacuacguuuacgacgccgcugauaauagcuccaagaaauauccgaugaacgaaacaggcuacgaccugcagcgguaucugcagaagguggaggggcuuccugcgaauuuccucaccuuugauauuaccuacagacuguggcaucugcucuauucugugaaagacaaggucgaguucgaaaaggcccugaaaaaguucgcucaggaauaccaacuugaugaggccagcuuuguggacuccuucaaaaacuuuaagcccuauccuaacgaguacggaucuuucucugaaaaagccaucaagaagcugcucccccugaugcgguuuggcaaucacugggauuucaaccgcauugacguuuccacacagaaaagaaucgaugaccugauuaaugggguggcuaacgacgagauccggaccaucauuagagaaaaggccgagaaauaccagcuuaauagcgaaucuuguuuucagggacucccccuguggcuggcgcaauaugucguguacaaccgccacgcugaggccacagauaucgagaaguggacgagcguuuccgaccucgaaaccuaucuggaggauuucaaacagcacucucuucggaauccuauuguggaacaggucgugacagagacccugagagucgugcgcgacaucuggcaacaguacggcggcgggcaggccaacuuuuucgaugagauucauaucgaacucggaagagagcugaagaagacagcugaggaacggaaacagcugagcaaucgcaaccaagaaaaugagaacaccaaucuuagaaucaagaaacuccuggccgagcugaaggaagacgcuuccauucagaacguucggccguauagccccgugcagcaggagcuccugaaaaucuacgaagagggcgucuuuucuuccacggaucaaguggaagaggacauucagaagauccgcaaaaaggccgagccuaccacacccgaaauucagagauauaagcuguggcuggagcagaaauacaagagcccuuacaccggggaaguuaucucucucacaaaacuguucaccgaggaauaugagaucgagcacauuaucccccaaucccgguacuaugaugacagccuguccaauaaggugauuugcgaaucugcggucaacaaacuuaagacgaaccagcucggacuggaguuuauccagaaucaucacggcgaaaaggugcgcauuacagggaacaaagaggugaccaucuucacagaggaacaauacaaggaguucguuaaaaagcauuaugccaauaacagcgcuaaacagcagaagcugcuccugaaugaaauuccggagaagauggucgccagacagcuuaacgauacccgguacaucuccaaauauaucucugaaauucugagcaagaucgugcgcuccgacgagaaagaugagggcgugaauagcaagaacgucauuccuuguaccggaaaaaucacaacggcucucaagcaagacuggggccugaaugacguguggaacgaacugauucuucccagauuugagcggaugaaucagcugacccagacacaacucuucaccucuuacaacgauagauuucaaaagaaucugccuacaguucccaucgaauacucccagggguuccagaaaaagcgcaucgaccaccggcaccaugccauggaugcgcucgugauugccugcgcuaccagagagcacaucaacuauaugaauaaccagcaugcccuggacaaaaacaaggauaaaaaggaaaagcaacagagccgcauugaccuucggacgauccugugugagaaaaagaauaacaauuggcaguuuaaaaagccuuggucuacauucacccaggagaccaaagaagcucucgagcacauugucguguccuuuaagcaaaaccugagaguuaucaauaaagccacaaacuacuaugaaaagugggaggaaaagaauggagugcuggucaaaaagaaagugaagcaggagggcaccaacugggccauccgcaaaccccuucacaaggagacaguuagcgggaagauugugcuggaucggaaaaucggaaaggacaaaauucucacggcuaccagaaaggaagucgauaucacauucaccgagaaaauuaucucuagcauuacagacaccggcauccagaagauccugcucaauuaccugaacuauaagggguccccggaaguggcguuuagcgccgagggccuugaggaacugaauaaaaacauugcucaauacaaugauggaaagaaacaucagccuaucuauaaggugcgcauuuucgaggaaggcucuaaauuuccccucggggagacgggagccaaggccaccaaguucgucgaagcugccaaaggcacaaaccuguucuuugggguuuaccagggaaaggagaaacgguccuacgcgaccaucccccugaaugaggugauugaaagacagaagcaaggccuuccuagcgugccggagcggaacgaaaaaggggagccccuucucuucucccugucuccuaaugaccucgucuaugugcccauggaaggcgagaucgcugagacaaucgacuuuaacaaccugagcaaggaacagaaagagcgcauuuacaagaccguuuccuucacaggaaaucagugcuuuuucgugcaggaagccgucgccaccccuaucgugaacaagauggaguauucuccccuuaauaaaauggaaagagauauucugggcacgaugaucaaggagguuuguauuaaacugaagguggaccggcucgggaacaucacaaaagcuuga

SEQ ID NO: 4539 - RNA, 4353 nt, Artificial Sequence
  Cas9 variant
augaagcacauccugggccucgaccuggggagcaacuccauuggaugggccuucgugcagcaagauuuugagaauaaacagggcaagaucauugcugccgggucuagaaucauucccauggaccagaaaaugcuuagcaacuucgaagagggaaccacagucucccagacggcggaacggaccacauaccgcucuaugagacggcugcgcgagagacaucuccugcggcgcgaaagacuucaccggguucugcauauccucggcuuucugccuccgcacuaugaugcucaaaucgacuucaccaagcgcuacgggaaauuuauugauaaugccgagcccaagaucgccuauaacaauggaaacuucauuuuuaugaauagcuucaacgagaugaucgaagacuuuaaggagcaucagccucagcuguucuacaaaaaguccaauggcgaagagucuaaaauucccuaugauuggacaaucuacuaucucagaaagaaagcucugagccagaagauuacccaacaggagcuugccuggcugauccuccacuuuaaccagaagcggggcuacuaccagcugcgcggggaagaggaaacagagaauccuaacaaagaaguggcuuuccacucccuuaagguggucgacguggaggccgaggcgcccaauaaaaagggagaaaucugguauaccauuagacuggagaacggcuggaucuaccggcgcacgagcaaaauuccucucgaugacuggaaggggaaaaccagagauuuuaucguuacaaccgaccugaaugaugacggaacaauuaagcuggacaaggaaggcaaagagaagcggucuuucagagccccggaugaaaacgacuggaaccuccugaaaaagaaaaccgagcaugauaucgacuucuccgggaagcccgugggaacguauaucuacgaucaccuucugcaaaauccuaaccagaagauuaaaggcaagcucguccgcacaaucgagcggaaauauuacaaggacgaacugaaagcuauucuugccaagcagaucgcucugcaacccgagcucuuuaccgaaacacugcuggccgauugcauuagagagcucuaucgcaagaaugaaacccagcagcagaaccugcuuagcaaagacuuccugcaucucuuuguggaggauaucaucuucuaccaacggccucugagaucuaagaaauccaccauugcgaauuguacacuugagaagcgcagcuacaucgacaaagaaacgaacgagcggaaggauacccccauuaagguuugcucuaaauccaauccguauuaccaggaauuuagagugcugcaguggcuccagaaccugcgcaucuaugagauugagacagaccgggaagucaccgccgaguucaucgaaacagcucaagacuacgaggcccuguuuaauuuccucaugagccagaaggaaauugauaacgagucccugcuuaaauauuuucuguucgcuaagaauccucagaucaaagacaagaccgccaaaaucgagcucaagaaguggauuacgacauacagauggaacuauguguacgauguggccgacaauucuagcaaaaaguaccccaugaacgaaaccggcuaugaucugcagcgcuacaugcaaaaagucgaggggcugccuaccaauuuucuuacauucgacaccacauaucggcucuggcaccuucuguacuccguuaaggauaaaguggaauuugagaaggcucucaagaaauucgcgaagaaaaagcagcuggacaaaacgagcuucguggauucuuuuaagaacuucaagcccuaucccaacgaauacggauccuuuagcgagaaagccaucaagaaacuucugccucucaugagauucggcaaucacugggacuuuaaccggauugaugucucuacccagaagcgcaucgacgaucugauuaaugggguggcuaacgaggacaucagaacaaucauucgggaaaaagccgagaaguaucagcugaauagcgaaaccuguuuccaagaccuuccgcucuggcuggcccaguacguuguguacaacagacaugcugaggccacagauaucgaaaaguggaccuccgucucugaccuggaggcguaucucgaggauuuuaaacagcacagccugcgcaaucccauuguggaacaaguugugacggagacccuucgggucgugagagacaucuggcagcaguacggaggcgggcaggcuaacuucuuugaugaaauucauaucgagcugggacgcgagcucaagaaaacagccgaagagagaaagcaacuguccgacaaaaaucaggaaaacgagaauaccaaccugcggaucaagaaacuucucgccgaacugaaggaggaugcuagcauucagaauguccgcccuuauucucuggugcagcaagagcuccugaagaucuacgaagagggcguuuucuccagcacagacgaaauugaggaagauauccagaaaauuagaaagaaaguggagcccaccacgccugagauccagcgguauaagcuguggcuggaacagaaauacaagucucccuauacaggcgaggucaucucccucaccaagcuguuuacagaagaguacgaaauugagcacaucauuccgcaaagccgcuacuaugacgauucccugucuaacaaagugaucugcgagagcgccguuaauaaacuuaaaaccaaccagcucgggcuggaguucauucagaaccaucacggagaaaaggugagaaucaccgcuaauaaagaagucacaauuuuuacggaggagcaauacaaggaguucgugaagaaacacuaugccaacaauuccgcgaagcagcagaaacugcuccugaacgaaaucccugaaaagaugguggcccggcagcuuaaugacacccgcuacaucucuaaauauauuagcgagauccuguccaagauuguuagaagcgaugaaaaggacgagggcgucaacucuaaaaauaucauucccuguacagggaagaucaccacagcucucaaacaagacuggggacugaacgauguguggaaugagcugauccuuccucgguucgaacgcaugaaccagcugacccagacgcagcucuuuacauccuacaaugacagacugcaaaagaaccuccccaccgugccuauugaguauagccagggcuuccagaaaaagcggaucgaucauagacaccaugccauggacgcucuggucauugccugcgcgacccgcgaacacaucaauuacaugaacaaucagcacgcccuugauaagucuaaagacaagaaagagaagcaacagucccggauugaucugagaacaauccucugugaaaagaagaacaacaauuggcaguuuaaaaagcccuggcgcaccuucacacaggaggcuaaggaggcccuggaacauaucgugguuagcuuuaaacaaaaccugcgggugauuaauaaggcuacgaacuacuaugagaaaugggaagagaagaaugggguccuugugaaaaagaagguuaaacaggaaggcaccaacugggccaucagaaagccgcugcacgaggagacauucucuggaaaaauuagccucaaucgcgaaaaggugggcaaagggaacauccugaccgccacacggaaggcugucgacuccagcuuugaugugaagaaaauuucuaagaucaccgacacgggcauucagaaaauccuccugaauuaccuuaaguauaaaggauccccugagguugcguucagcgccgaagggcuggaggagcucaacaagaauaucgcucaauacaacaauggaaagaaacaucagcccauuuauaaggugagaaucuacgaaaaaggcuccgggcgcuuuguccugggcgagaagggaaccaaaucuaagaaauaugugcagggcgcccccaaccuguacuucgggguguaccagggaaaggaaaagcggacauaugccaccauuccucuuaaugaggucaucgaaagacaaaaacagggccugccgagcguucccgagcggaacgagaagggggaaccucuccuguuuucccucucucccaaugaucugguguacgugccuauggagggagaagcuacagagaccauuaacuucaacaaucuuaacaaagaacagaaggagcgcaucuauaaaacagucagcuucaccggcaaucagugcuuuuucgugcaagaggccguugcgucccccaucgugaacaagauggaauacucuccucugaauaagauggagagaagcauugucgggaucaugauuaaagaaguguguaucaagcugaaaguugaccggcucggcaacauuacgaaggcuuga

SEQ ID NO: 4540 - RNA, 4362 nt, Artificial Sequence
  Cas9 variant
augaagaccgugcugggccucgaccuggggacaaacagcaucggaugggcccuuauucagcacgauuucgacuccaaaaagggcgagauccuggggaugggaucuagaauuauccccaugagccaagauauucucggcgaauuugggaaaggaaauuccgucucucagacggcugaccggaccaaguuccgcagcgccagacggcugcgcgagagacaucuucugcggcgcgaaagacuccaccggguucugaacauccugggcuuucucccucgccauuacgcggcugauaucgacuucgagaaaagacugggccaguuuuucgaagggaaggagccgaaacuugccuaugauaauaaccaguuuauuuucacaaaguccuuuggaaagaugcuggccgacuuccggcaacaccagcccgauuuucucaaagacgagaagucuaaugaucugcuuaucccuuacgacuggagcauuuauuaccugcgcaaagaagcucucaccaagaagaucgagaaagaagaacuggccuggauuauccugaacuucaaucagaagagaggcuauuaccagcuccggggagaggaagaggaagagaaccugaauaaacuuguggaauuucauucccugaagauuaucgauguggucgcugacgagaaacucaacaauaagggagagacaugguauagccugcuucuggaaaacggcuggaccuaccgcagaucuuccaaagugccccucuucgacuggaaggagaagguucgggauuucaucgugacaaccgacauuaaugaugacgggagcgucaaaacggauaaggaaggaaacgagaaaagaucuuuucgcgccccuuccgacgaugacuggacccugcugaagaaaaagacagaacaagauaucgacaagagccggaaacccauuggcgcguacaucuaugaugccauucucaagaauccuaaacagaagaucaacggcaaacuggugagaaccguugagcgcaaguucuacaaggaggaacuuaaacugauccuccagaagcagaaagaguuucacccggaacugcaaucuacagaccuuuauaacgagugcauucgggaacuguacaagaauaacgacgcucaccagcuccagcugaauaaaaaggauuucgugcaucuguuucucgaggacaucauuuucuaucaaagaccccugcgcucccaaaagagcuccgucgggaacuguccucuugaguuucggaaauucaaggauucugaaggaaucgagaaaguggaauaccugaagaccauucccaaaagcaauccuuauuuucaggaguucagaaucuggcaguggauguacaaccucuccaucuacaagaaagacgaugacgagaaugugacgcgcgauuuucugaagacaauugaagacugggaggaucuguucgaauuucuuaaccaccggaaggacaucgagcaggaaacccuccugaaauuccugcucggcaagaauggggucaaaggaaaggcccugaaaguugaggcuggcaaguucagauggaacuaugugagcgauaagauuuaccccugcaaugagacaaaagcccuuaucauuucuaagcuggaaaaagugaagggggucgaggaaaaauuucucaccgaggaaaucgaguauaagcuguggcaucugauuuacuccgugaccgacaagguugaguaugaaaaagcgcuuaaggccuucgcuggaaaacagaagcucgaucuggugagcuuugucgacucuuucaaacgcuuuccgccuuucaagaacgaguacggcgccuauagcgaaaaggcuaucaaaaagauccugccccuccugcggacaggcaaauccuggaauuggauggccauugacucuaaggugagagaucggaucaacaaaauuaucacgggggaguuugacgaagagauuaagaauaaaguucgcgagaaggccgaaaagcacagccuuaaaaaggagaacgauuuccagggacugccucucuggcuggcucaguacguggucuacggcagacacuccgaagcgagcuuuucugggaaauggaacuccguggacgaucugaagaaauaucuugaggaguucaagcaacauagccuccggaaucccaucgucgaacaggugcugaccgagacacugagaguuguggccgacaucuggcaguuuuacggaaagggcgaaaaagauuucuuuucugagauucacaucgaacucgggcgcgagaugaagaacaccgcugaggaccggaaagaaauguccgccauuauccaggccaaugagacaaccaaccugagaauuaaggcccuucugaaugaacuccugcaagauaaaaaggucgagaacgugcgccccuauagcccuucccagcaggaaauccugaagaucuacgaggacggcguucuuucuagcgauauugagaucccggacgauauucagaaaaucuccaaggcugcgcaacccacgaaaucugaacuccagagauauaagcuguggcuggagcagaaauaccggagcccuuauacaggagcuaugauuccccucggcaagcuguucaccuccgaauacgagaucgaacauaucauuccucaaagccuuuacuucgacgacucuuuuuccaauaaggugaucugugagagcgccgucaacaaacugaaggauucucgccucgggauggaguucauuaaagaaugccacggaauggugguggagaccggcuuugggaaguccguuacagucuucgaagaggagaccuauagagacuuuguggugcagaauuacagcaaaaaccauucuaaaaagagcaagcugcugcuugaagagauccccgaaaagaugauugagcggcagaugaaugauacacgcuauaucuccaaauucauuagcucuguccuguccaacaucgugagagaagagguuaaugacgauggagugaacagcaagaauaucgucccgggcaacgggaaaauuacgacccagcucaagcaagacuggggccugaacgauaucuggaaugagcucauucugccucgguuugaacgccuuaacgugcugacagacuccaaacacuucaccgccuggucugagaaucaccagagacuccugcccacaguuccuaucggacugagcaagggcuuuuccaagaaacggauugaucaucgccaccaugcucuugacgcccuggugaucgcuugugccucuagaaaccacaucaauuuccucaacaaugcgcacgccauugauaagaaaaagaacagcgaagagaaacagaaguuucggcaugaccugaaggcuauccucugcgacaaaaaguacuccgauaaaucugaaaagaauuauagauggauuuucaaaaagcccugggacaacuucaccaucgauagcaagaaugcccuggacaaaauuaucgucuccuuuaagcagaaccuucgcaucauuaauaaagcuacgaaccgguacgagaaguggguggauagagacgggaucaaaguuaaggaguggcacaagcaagaaggaauuaauugggccacccgcaaaccucugcauaaggauacagugagcggcaaagucgaccucaagcgggugaccgugcccgaggggaaaauccugacagcgaccagaaagucucuggauacguccuucgaccuuaaagucauugaaagcaucacagauaccgggauucagaagauccugaagaacuaucucacaucuaaauccaacaauccggagcuggccuuuagcucugaaggcguugaggacaugaacaagaauauccgcaaauacaacgaugggaagcuccaccagccuauuuacaaagugcggaucuucgagcugggcuccaaguuuccccuuggacaguucggcaauaagaaauuuaaguauguggaaaccgcuaaagggaccaaccuguucuuugccgucuacgaggacgaaaauaagaacagaaauuaugagacaauuccccugaacgugguuaucgagcgccaaaaacagggacucagcuccgugccuauuaagagcgaaaagggccauaaacugcuuuucuaccugucuccgaaugacaucgucuaugugcccgggagcaacgaggaauuuuccaucgaucggcucuacagauucacggacucuagcgauaagaccgcuaauuuuauuccucuguccguuucuagccucaucuucuccucuaacaaaaaugagcagaagaaaauuggaaucagcuaucccauucaagacgaguucggccugggguccccucagagcaagaaccagaagucuaucgauggcaucaugauuaaagagaagugugugaaagucaauaucgaccggcuuggacgcguguccuuuuga

SEQ ID NO: 4541 - RNA, 4368 nt, Artificial Sequence
  Cas9 variant
auggccaagauccugggccucgaccuggggaccaacagcauuggaugggcuguggucgaggaucagaauaacaaaacaacgcuuaucgacaagggcguuagaauuuucuccgaaggggugaaaaucgagaagggaauugaaaaaucuaaggccgcggagcggaccgauuuucgcagcgcuagaaagaucaaauuccggcgcagacugcggaagcaagaaacacucaaagugcugaucgagaauaacaugugcccccuuaccauugaggaauggacaaaguggaaaaaggacaagaaagaguacccuaagaauccggauuuuaucaacuggcugaaaaccgacgaacucaagaauauuaaccccuauuucuuucgcgauaaagccuccagaacagagcugccucugaugcagaccggccgggcccucuaccaccuggcucagcgcagaggguuccuuucuaaucggcuggaccagggaagcgauggcuuuacggagcaaauccgccucgaccugauuaagaaaaucgaaugugagaccgauaagacagaacuucugaccuccguccagucuauuaucgacacauauagcgaggaagaggauaaggacgccaaaaagcuccugaaaggcguggagaagcugugcaaaaucaacaaugaacuccccauuaccgaguucaaggaaaagcugaucaacuaccuuaauaaagcugacaaccugggggccguuaagaaaggaauugcggauguguccaagaaaaucacggagacaggcugugaaacccucgggcaguauuuuuacaagcuguaucagaaucaaagcaagauuagaaaagucuacacagcccggaccgagcauuacuaucacgaguuccuuaagaucugcgaaacccagaacaucugugaccagcugaaacauaagcucgauaaagcuauuuucuaccagcgcccucugaagucucaaaagggacugaucggcaaaugcguguucgagaagaacaaaacaagaugugccguuucccaccccgcuuaugaagaguaccgggcccuccaguuuauuaauagcaucaaggugucugaaacgaaagacgggaagaaagauuuccuguccuucgacgagagaaagaagauuuggccuaaauuuauccgcaagagcaaaccgaacuucgauuuuaaggagaucgcggaaacccuugacaaaaagggacugucucgguauuacaauuauacaggccauaccuccgucagcggcugccccacaauugcccagcucaccaacaucuucggggagaauuggcaagaaacgcuguuugagaaguacacaaacaaacagaauaccaagggacuuaaaaccauugaugagguggugacagacaucuggcacguccuguucaccuuugauaaggacgaaaagauuaucgaguucggcaaacagaagcucgggcugaacgaaguucuggcuaaaaaguuuggagccauuaaucucaaaaaggacuacgcuucccugucucuuaaagccaucaacaagauccugccuuaucucagagagggccugauuuacagcuaugccguguuccuggcuaauaucgaaaacguggucggggaggagauuuggaagaaugaugaaaacaaaaaucuuaucaagaaagagcuccaucugcugauugacaacuuuaacgaaaucaagggacucgaggcggugguuaaugauuucaucgccgacuuuaaaaaggaauacaacaaugcucacaaagauuaugugcuggacgagcaggauaagaagauucuucuggagaaaaucgaauccaacuacggcaagaauaaauucgagagccucgaacccgacaagaaaacagagauuaucaacucuacggaaaagauggucgccgagcaacugcgcaagcagcggggcgaguucauuaaaccuaagagacuggaugagaaaaucuccgaauuucuuaucaauaacuucaaugugaccaagaaaagcauugcccgccucuaucaccccucugacguugaaaucuuuaagacagcuagccggaacuccgaggggcugcugcuccugggaucuccgauugugagcuccaucaagaauccuauggccaugagagcgaugcaucagcuucgcaaacuggucaacacccucauuaaggagaauaucaucgaugaagagacaaaaauuaacaucgaacuggcucgggagcugaaugacgccaacaagagagccgcuauuaaaaaguggcaggaugaacgccaaaaggcccgggaggaguacaaaaagagcaucaaagaacuuuucaaggcugaguguggcaaagacauugaacccucugacuccgagauccucaaguacgaacugugggaggagcagcagcacauuugcaucuauaccgggaagacgaucaacauuugugauuuuaucggagccaauccuaacuucgacauugaacacaccauccccaaaagccugugcuuugauaauucuaacgagaaucucacacugugcgacauucaguacaacagagaugugaagcggaauaaaauccccaccgaacuuuccgacuauaacagcaucaagccucgccuggauaaauggcucgucuucauugacgauuacgagaagcuguauaauacacggaaaaaggcgaagggcaucgaaaccaaagagcaaaaggacaaaagaauuaaggagaaacauuacuauaagcugcaccuugauuacuggaaggggaaauacaagagauuuaucaugguggacguuccguccggcuucaaaaacucucagauuguggauacgggaaucaucacaaaguaugccauuagcuacaugaaauccaucuuucccaaggucuauucugugaagggcaauauuguugcugaauuucgcaaaaucugggggcuccagaacgacuacgagaagaaagaacgggugaaucauguccaccauuguauugacgccaucaccauugcuugcaugagcaagcagaaauaugauacacuggccaagaucuaccacgaggacgaggcgggauuucacaagaucaaaaaggaaacccaacugguguccaaaccuuggaccagcuucacaauggaugugcucaacauugagaaggaaaucuucguuucucaucacacgcccgacaauaugaaaaagcaguccaaaaaggucgugagagagcgcggcauuaucgccccuaaggugauuuaugaaaccgaugcuaacaacaauacacugagagacaaauacgggaagaaaaucgucaaggaguacauccuucugaaagaugugaacggaaaucucauucccaucaagggcaagcggcugaccccgagcgacauuaucaacaaaguugaugggauugacuauuuuucucugaucaucaaugauaagauucaguacuaugaguucgccaaauccaagaaaacaggcaagaucauuuacaagaaagaaccuaucuaucuucaaggagacaccgugcgcggcagccugcaucucgacacguuuuacggggcuauugccaaggauaucaacggaaauauuaucacaaacaccaauggcaaaaucgcccccaacuaugucauuagaaaggagcugucuaaacucaaggaaaccgacaucgagaauauuguggauccuguugugcgggggaagaucauugaagcuaaaaagaacaaacugaucacauucaauaagagcggagcggucaucaaaaccacaauuuggaugaaggagaaccagauccccauuaauaaagugcgcguuuacuccagccuuaagaacccucugcccgacuuuaagaaacacagagaucucucucaccugacguacaagcagcaguauaauguguccaacgaggaaaacuacugucuggccaucuaugagggcaaaaauaagaaagggaacgucugccggaccugugaacuugugaauaugauugacgcuggcaacuacuaucgccugagcaauaagaacuggaagcaacaguacccgaucgugccugagaaagauuccgucacaaauuauucucucaagaccaucauuacaaaaggacugaugguucuccuguacgaaaagagccccgaggagaucugggaacuuaccuacaaccagcagauggagagacuguaugaaauuacgcaacucgacaccgagaaauccgccgagaucaagcugcuguuccaucaggaagcccgggagaagaaagugauuacagaauacaugggccuuaagaccgggaugaaaggaggcaagaauaucgggaaacacaaggaguuucccuggauuaaggugggaccuaacucuuucgaugcucugaucgaaggcaucgacuuuaaacucacaccgaccgggaagauuaucaaacuguga

SEQ ID NO: 4542 - RNA, 4374 nt, Artificial Sequence
  Cas9 variant
augaagaccauccugggccucgaccuggggacaaacagcauuggaugggccaaaguguccgucgaugacuacggcaauuaucuucacgauaucaagcuggggucuagaauuauccccaugagccaggacguucucggaaacuucgauuccggcgugacggugucucaaaccgcucagcggacagaguuucgcagcaaaagacggcugguccagcgcaaucuucagagacgggaacgccugcauagagugcuccacguucuggacuuccugccugcccauuacgaugcggcuauugggugggaccggaccgaggccgugacauauggaaaguuucucaaccacgccgaaccgaaacuggcuugggaggaacuuggcaauggcaagcgcagauuccuguuuauggauuccuuccaugagauggucgccgacuuugcucggugccaacccgcccucguggcggaugggaagaaaaucccucuggacuggaccaucuacuaucuucgcaagaaagcccugacacaggcuauuaccaaggaggaacucgccuggauccugcugaacuucaaucagaaaagaggauacuaucagcuccggggcgaggaagaggaggaaaaccccacgaagcaagaggaauacuacgagcugaagguugugucugucgaagcuaccgauagccgcaaagggaaugacacaugguauaacgugcaccuugagaauggauggauuuacagacgguccagcaagaucucucuggacgauugggugggcaaagucaagcaguuuauuguuaccacagaguaugaaaaagacggggccacccucaagacggauaaagagggauacgugaagagauccuuccgcgcgccuaacgaaaaugacuggggccugcggaagaaaagaacagagacccuucuggaaaugagcggcaagacagugggggccuuuaucuaugaucaccuccugcaggagcccgcugacaaaauucgcggaaacuucauccggaccaucgagagacauuacuauaaggccgaacuggaggcuauucucgccgaacaguguaaauaccacaucgagcugcgcgauaaggaaaugcuugaggccugcgcucgggagcuguaccucaauaaccugccucaucaaagaucucuuaugaagaaagacaugaccuaucugcuccuguacgaucugaucuuuuaucagcgcccgcucaaguccaaaaaggcgcugauugccaacugucccuacgaauauuacgaguaugucgacaaagaaacaggcgagauuaagcggcagaauaucaagugcaucgcuaaaagcaacccuuacuuccaagaguucagacuuuggcaguuugugcugaaucuccgccuguucgaucggguugaagacaaggaggugacggccaacuaccugcccaccgccgacgaucacgcuagacuuuuuacauaucucaaugaccggaaagaaauuaaccaggagacccugcugaaggauuacuucaaacucaagaaggucaaaaucgggaaugaaaaggaguauccuauucgcuggaacuacaucgaggacaaagaaaagaaauaucccuguaaugagacaagauacgaacugcuuauggcccuggaucgggcgggaauugagcacaaguggcucgacgauaacaaucuggaauauagacuguggcaucuucucuacucuguggagguuaaauccgagagcgaaaccgcucugcgcaagcugaagaacgacgaugccuuugugaauagcuuccucaaagucaagccguuuaaaaaggaguacggcgccuauucugaaaaagcuaucaagcggcugcuugccgugaugagaaagggguuccuguggaacgagcaggacaucugcgaugaaacgcgcaaaagaauugagaucauuaucaagggagacgucgaugagaaagugaaggaacggaugggccacgcugccuacagcuuugaccgcguuuccgacuuccaaggccucccugaguggcuggcguguuauguggucuacgggagacauagcgaagccauggauauucagcacugggacucucccgagcggcugauggcuuauaucaauaacuuuaaacaguacucccuucgcaacccuauuguggagcagugcauccucgaaacacugagaaccguucaugauaucuggaaggagaccggacaaauugacgaaauccacguggagcugggccgggaaaugaaguccacaucugaggagcgcgccagacggacccagaauguccuccgcaacgaaaauacaaaccugagaauuaaaagccuucugaucgagcucaagaaugauacggacauuuguaacgugcaccccuauucccccaugcagcaggaaauccugcggaucuacgaggaaggggcucugcaagagcuuaauagagaggaugaagacuucgaggaaauuucuaaaaucagccagaugucccagccuagcggaaaggagcucaaccgcuacaaacuguggcuggaacagaaguaucggucuccguacaccggcaaggccauuucccucgcgaaacuguuuacacccgccuaucaaaucgagcaugugauuccucagagcagauacuucgaugacucuuucaccaauaagguuaucugcgaggcugaagucaacacacuuaaauccaaucugcucggguaugaguuuaucaagaaacacggcggagaaauuauccauuguaccacgcugggcgaugugcgcauuuucagcgaguccgaguacaaggccuuugugauggaccacuaugcuaacaauaaaucuaagaaggauaaacugcuuauggaagacaucccccaggaguuccugagccggcaaaugaacgacuccagauacauuucuaaggucgugaaaacccuccugagcaauaucguucgcauggccgaugaauccgaggccacaagcaagucugugaucgucugcaccgggggagugacagaccggcucaaaaaggauuggggccugaacgacguuuggaacuccauuguguacagcagauuugaacgccuuaaucggcugaccgggacggaggcuuucggacacugggagaacaaggauggcaaaagagucuuucagacaucuaugccucucgaacugcagcggggguuccgcaagaaaagaaucgaccaucggcaccaugcgauggaugcccuggugauugcuugcgccucccgcaauaucguuaacuaucuuaauaacgagagcgccaauaaccccaagaaaagagaagaccugcggagacagcucugugauaagaaucgcgugauucggaagccgugggagaccuuuacacaagacgcuuacaacgcccuggaaaaugucguggugucuuucaaaaacuaugucagaguuaucaauaaggcgaccaaccgcuacgagcacuaugaugagaauggcaaaaagcgguuugugcagcagaaaggaagcgaacucugggcuauuagaaagccuaugcauaaggagaccuacuauggccacgugaaccugcgccggaaagaacuugucacacugcagaaggcccucgacgacauccccuccaucugcgauaaaaagcugagagacuacauuagcgcccugguggagaaacacuucaacaagcgccaacuucuggcucauuuuaagucuacggauuacuauuggcagaaacaguacguuaauaagguguaugucuggaccuucuccgacgauaucaaaccucucguggccacaagaaagcugcucgacaccagcuucgaugcgaaacggauugggacaaucaccgacacgggcauucagaagauccugcgcaacuaccuugaagcuaaaggagggaaugccacacuggccuuuacccccgagggaaucgcugagaugaaccaaaauauuuccaaguauaacgauggcaagccucaccagcccauccugaaaguuagaauuaccgaaccgaugggggccaaguaccgggugggccagacaggaaauaaaauggcuaaguaugucgaggcccaaucuggcaccaaccucuacuucgcgaucuacgaagacagcgaggggaaacgcuccuauacaacggugccucuggaugagguugccgaaagacuuaagcagcggcugucucccgugcccgagaaggacgaaaaugaugucccucucaaauuuuaccugagcccgaacgaccucguguaugugcccaccgaggaggaacugcagcuuagagaguguaagcugaauaaagaccgcauuuacaagauggucuccucuacaggaaacgaaugccauuucaucccuuauuacguugcuaaugugaucuauaacaaaggcggguuuaauaugcagaugcaccggccccaaagcuga

SEQ ID NO: 4543 - RNA, 4374 nt, Artificial Sequence
  Cas9 variant
auggccaagauccugggccucgaccuggggaccaacagcauuggaugggcuaucguggagaaaaauaacuccgauuucacacuuauugacaagggcgucagaaucuuuucugaagggguuaaaacggagaagggaauugaacggagccgcgccgcggagagaaccggcuaccgguccgcucgcaaaaucaaguauagacggaagcugcgcaaauacgaaacacucaaggugcugucuaaaaauagaaugugcccccuucagaucgaggauguggaggccuggaagaaaagcggguucaaggacuauccucugauuccggaauuucuccaauggcugcggaccaacgaucacgagaaugucaaccccuacuucuuucgcgacaaggccuccagagcuaaagugucucugugggaacucggacgggccuucuaucauaucgcucagcgcagaggcuuucugagcaaucggcuugaucaguccagcgagggcguucuggaggaacacaacccucagauucaaucucucaucgaggaccuggaagagacauccaccauucuuaaugaagugcgcgauuacuauaucaaccuggggcuccuggacggagucaagggcgauuucaaaaaggagcuggacgagggggagaaaaagcucaaaagccuguacaauacacuuauugccaucaucaagaagaacgaaaaugaugugcagaaauguaaggacgaaauuaucaaaagacugaacaagaaagaggaccucggaaagguuaagggcaaaauuaaggauaucucucaggcgaugcuggacgggaauuuuaaaacccuuggacaguacuucuauucccuguacaacaagggcaaaauucggaaccaauauacgagcagagaggaacauuaccuccaggaguuuaucaccaucugcaaggugcagggcauuaaugggaucaacgaugaagagauucugcccgaaaagaaauucacaggacuggccaaggaccucuauaaagcuaucuuuuuccagcgcccucugaagucucaaaaaggccuuauugggaaguguuccuucgagaagaauaaaagccggugcgccaucucccaccccgauuuugaagaguacagaauguggaacuaucugaauaccaucaaguucggaacacagucugacaaaaagcuccgcuuucugacccaggaggaaaaacuuaagcugauuccuaaauucuaccggaagaacgauuuuaauuucgagguccucgcuaaggaacugaucgacaaaggcgccacguuuggguucuacaagagcucccggaaaaacgaguuucuguauugguucaauuacaagccgacagauaccgugagcgcgugucaauuuucugccucccucaaaaacgcuauuggagaggacuggcagacaaagguguucaccuauaagacccugaauagcgagaaaaaggaagucauccgcacaguugauuaccgggaccuuuggcaucugcucucugccagcacguccgacauuuaucuguacgaauaugcuaaagagaagcugggccuugaagauaaaucugccaagaccuuuagcaagaucaaacucaagaaagacuucgccucccugagccugucugcuauuaacaagauccuccccuacaucaaagagggccugcuuuacucccacgcgguguucauggccaauauugagaagguggucgaugaacacaucuggaaggacgugaaagagagaacaauuauccagaacgaaauuagcaagaucaucaaaucugauguuuuugagcgcgaagugauuaauaucauuaacgggcugaucaagaacuccaaaaccgagggagagaauuaugcugaagagagcaagaacauuuucaaaacagaauuugacaaugccaucgccaagaucuucgagaagaacaaugauauugaauuuaaccagccuuuccucgacgauaccuaccugaaauaugucgaggagcugaagaaauuugacaaggcucgguccuuccuucccgugccuagacucgaugaaaaaguuauccaauuucugcugggcaauaacaaggacgggaugguguacugcucugauaagaauaaaacgaagaaacucuaucaucccagcgacauugagaucuucaagaaaaagauuaucaaggacgaauuuggaaacgagaaaaugguccugggcuccccgcuuacaaccucuaucaagaauccuauggccaugcgcgcgcugcaccagcuccggaaagugcugaacacccugauucuugaggaacagaucgaugagaauacacggauucauaucgaaauggcuagagagcucaacgacgccaauaagcgcaaagggauucaggauuaccaaaacgaaaacaagaaguucagagaggacgccaucaaagagauuaagaaacuguauuuugaagaguguaagaaagaagucgagcccaccgaagaggaugugcugcgguaccagcucuggaucgagcaggacaagaaggaaaucuacgagcagggcaaaagcauuagaaucuccgauauuaucggaagcaauccugcuuaugacauugaacacacaguuccccgcucuaucucccaaaacaauagccugaugaacaagacgcuuugcacccccagauucaauagagagaucaaaaagcagaaaaugccuauugaacugucuaacuacgaggagauccucccgcgcauugaacacuggaagaaagaggccgaagaucugacaagacagaucgaguccauuagcaagucuaucaagagcgcuuccaccaaagaggccaaggacaaaaauauccggcgcagacauuaucugacacuuaagcgggauuaccucaaaggcaaguaugaccgcuucauuugggaggaacccaaggugggguuuaaaaacagccagaucccugauaccggaauuaucacgaaguacgcgcaagccuaucugaaaucuuacuucaagagagucgaauccgugaaaggcgggaugguugcugaguuucggaagcaguggggcauucaggaaagcuacaucgacgagaauggauucaagcacuauaaagagaaggaccgcuccaaacauacccaccauacaauugaugccaucaccaucgcuuguaugacaaaggacaaauacgaugugcuggcccaagcguggaccucugaagacgagcaggauaagcagaaggccaaaacgcucaugagcgaagcuaagcccuggaaaacauuuaaggaggacauugagaaaaucgaagaggaaauucuggucucccacuucacccuugauaacgugaagaaacagucuaagaagaucgugagaguucgggggaaaaagcaauaugucgccgagauugaacgcgacgugaauggcaaagcuauggccaagaaagaugccaacggaaagaucaucuacaagcugaaugagaaaggcgaaaagauuccuagacuccagcagggggacacaauccggggaagccugcaccaggauuccauuuauggcgcuaucaaaaacccccugaaucaagaggagauuaaguacgugaucagaaaagaccuugaaucucugaaggcgaacgacgucgauaacaucguggacgagaccguuaagcagaaagugaaggaagccauugagaauaaaauccuccugcucagcuccaacgcucagcagaagaauaaacuggucgaugacguguggcuuaacaaggagaagcaaguuccgauuaaaaaggugcgcaucuaugccaauagcgucaaaaacccucuggaaauuaaggagcagucucuccuguccaaaagccggaaggaacauaaacagaagguguacgggcaaaaugaugagaacuacgccauggcuaucuaugaacuggacggaaagagagaguuugagcuuauuaauaacuucaaucuggccaaacucaucaagcagaaagaaggcuuuuacccccugaacaaggagaaagaaguuaaggggaagaaagugcucuauccuaucgcgaagucuaauuaccgcgaugucgugcugaaacggggccaacagguggucuucuaugacaaggagguugaaaaccccaaagauauuuccgaggugaucgacuuuaagggaagaauuuacaucauugagggccuuagcauccagcgcaucgugcggccuucugggaagauugaugaauauggagucaucaugcugaaauacuucaaggaggcuagaaaagccgacgaaauuaagaaagauaauuacaagcccgacggcguguucaagcucggggagaaccgcccgacccggaaaaugaaucacucccaguuuacagccuucguugaaggaaucgacuuuaaggugcugccuacgggcaaauucgauaagauuuga

SEQ ID NO: 4544 - RNA, 4377 nt, Artificial Sequence
  Cas9 variant
augaccaagacaauccugggccucgaccuggggacgaacagcauuggaugggcccuuaucaaucaggauuucgacaacaaaaagggcgagauucuggggaugggauccagaaucauucccaugacccaagauaucaaagacgaauuuggcaagggaaauucuaucagccagacagcugagcggacccgccucagaggggugcggcgccugauucacagaacacuucugcggcgcgaaagacuccaucggguccugaacaucauuggcuuccugccugagcacuacgccaaucagaucgauuuugaaaaacgcuucggcaaguuuaagccggaguccgagcccaaaauuucuuucgacgggaacgauguuuuucucuucgaaaagagcuaucaggagaugcugguggacuuuaaaauccaucaaccucagcuuguguccaauggaaagaaaauuccccacgauuggaccaucuacuaucugagaaagaaggcgcucucuaaaaagaucgaaaaagaggagcuggcuuggauucuucugaacuucaaucagaagcggggcuacuaucagcuccgcggggaagaggaagaggaaacaccuaacaaacuggucgaguuucauagccugaagaucguggagguuaaugccgacgaaccccaaaaaggaaagccugagauuugguacucccucgugcuggaaaacggcugggucuauagacgggccagcaagaccccgcuuuucgauuggaaagacaagauccgcgaguuuauugugacgaccgaaaucaauaacgaugggacaguuaaaaccgacaaggagggaacagagaaaagaucuuuccgggcucccaagccugaagacuggacccugcagaagaaaaagacggaguucgaacucuccaaaagcggcaaugaggugggcgccuuuaucuacgaaucuauucugcagaagcccaaccagaaaaucagagggaaacuuauuuccacaaucgagcgcaaguucuacaaagaggaacugaagaccauucucaaaacacaacuguuuuuccacaaggagcugaaagaugaaaagcucuauaacgcuugcaucgaggagcuguacaagaauaacgaagcccaccggagccuucugucuaauaaaggauuugagcaucucuucaucaacgacauucuguuuuaucagagaccucuucgcuccaagaaaagccagaucuccaauuguccccuggaaaagcggaccuacaaaaaggagggcauugaaaucaccgaggggauuaaagucaucucuaagagcaacccgauuuaucaagaguucagacucuggcaguggaucuccaaucugagccuguacugcaucgaaccuacagagacgaacgugaccucuacauuucucaauuccauugaagauuaugagaaccuguucgaauuucuuaauaaccgcaaggagaucgagcagaaacaucugcucaaguaccugcuggaaaaucagggauucaaaggcaaacuucucaccaacgagcuggaaaaguuucgguggaauuucguggcggacaagaaguaccccuguaacgagacagggagccugcuccacaccagacugucuaaagucaagaacauuagcccugauuuccuuacgaaagaaaucgagcaccaacuguggcacauuaucuauuccguuacagacaagaucgaguacgaacaggcccucaaaaccuuugcucgcaagaauaaccuggauguggacucuuucuuugagcauuucaagaaaauuccucccuuugaaagcaccuauggagccuacuccgagaaggcuaucaaaaagcugcuuccccucauucggcugggcaaauauuggaauugggaggccaucgauagcauuucuaaggacagaaucuccaagauccugagcggcgaauacgaugagaacauuaaaaaucgcgugcgggaaaaggcgguccaccucacaucugagaacaauuuccaggggcugcaggaauggcuugccaaauauaucguguacgacagacauuccgagggaaacgaccugggcaaguggaccagcguuuccgaucucgagacauaccugaaagaauuuaagcaacacucucugcggaauccgauuguggagcaggucaucacggaaacccuucgcgugguuaaagacauuuggaucaagcaugggaagggaacagagaacuucuuugaugaaauccacguggagcucggcagagagaugaaaaauaacagcgaagaccggaagagacugaccaauacaauuaccgagaacgaaaauacgaaccugcgcaucaaagcucuccugauggagaugaugaacgauaaugacgucgaaaacgugcggcccuauuccccuucucagcaggagauucuuaagaucuacgaggauggggcccugaauagcaacauugaacucgacgaugagaucgucaaaauuuccaagaaggcugaacccaccaaaagcgagcugcaaagauauaagcuguggcuugagcagaaauaccgcucuccuuauacaggccaggugaucccccucaauaagcuguucaccuccgaauacgagaucgaacacguugugccgcagagcagauuuuucgacgauucuuuuuccaacaaagucauuugcgagagcgccgugaauaagcggaaggacaaccaacugggacuccaguucaucaaaaaucauucuggcgaaaagguugagcugggguucggaaaagugguccagguguuuacagaggaacaauaucuugauuucgugaaggagcacuacagcaaaaaccgcuccaagcauaauaagcugcuccuggaagagauuccugaaaagaugaucgagagacagcugaacgacacccgguacauuagcaaguuuguuucuuccauccuuagcaauaucguccgcuccgagaaagacgaugacggccugaacucuaagaauauucuccccgggaacggaaaaaucacgacagaacugaagagagauuggggccucaacgacguguggaaugaucugauucuuccucgguucgagcgcaugaacaccaucacaaauagcgaccuguuuaccaccuauaacgauaaguaccagaaacaccuccccacagugccuuucgaauauuccaagggguuucagaaaaagagaauugaccaccggcaucacgccauggaugcucuggucaucgcgugugccacgcgcgaccaucugaaucuuaugaacaaucaaucugcuaaaagcgagcugaagagauacgaucuccagaacaaacugcggaagaaggaacccuauuucaaucagaaagagaacaagcagaaagaggccuuuaaggacuucaucaaaccguggggcaccuuuacagaagauuccaagaaugcccucgagaagauuaucauuucuuucaaacaaaaccugagagugaucaauaaggcuaccaacagcuacgaauccuauaaagacgaggacggaaaucuucgcauuggcaaggaugggaaaccugagaagggacugaucaagcagaaaggccucaacugggccauucggaagccccugcacaaagacacaguuagcgggcagaucaaucugucuagaaucaaacuucccaacggaaagauucugaccgcgacgcgcaagaaccucgauacauccuucgaccugaagaccaucgaaaauagcauuaccgauacaggcauccagaaaauucucaagaacuaccugcuuucuaaagaguccccugaacuggcuuuuagcccggaggggcuggaagagaugaauaacgagaucgaaaaguacaauaacggcaaauuccaucaccccaucaauaaggcccggauuuaugagcucggaucuaaauuuaacgugggccaaaccgggaauagacgcgacaaguucgucgaagccgcuaagggaacaaaccuguuuuucgccaucuaccaggaugagaauaaaaaccgguccuaugaaacgauuccucuuaaugaggugaucgagcaccagaaguggagagcuagccugcccaaagaggagcaagaaaagauuccucucguucccgugaacaaacugaagggcaccuuuaucuucucccucagcccuaaugaccuggucuacgugcccucuaacgaugagcuugaacgcagcgccuccaucgacuuuucuaagcugaaaaaggagcagauuaaccggcuguauaaaaugguuagcuccucugggagccagugcuucuuugugaaguccgaggucgcgacaucuguggugaauaaaauggaauacagcucccucaacaagauggaaaagagcaucgauaaucugauggucaaagaaauuuguaucaaacuuaagauugacagacugggaaacaucucuaaggccuga

SEQ ID NO: 4545 - RNA, 4377 nt, Artificial Sequence
  Cas9 variant
augaagaaaauccugggccucgaccuggggaccaacagcauuggaugggcccuuaucgagcaggauuucgaauccaaggcuggcaaaauuucuggggccggaagcagaaucauucccaugucccaagacauccugggcacauuugagacggggcagucuuacagccagaccgcggaucggacacacuaucgcuccaucagacggcucuaccagcgcaccaagcugagacgggaacgccuucauagaucucugaaugugcucggauuccugccugagcacuauaaaaacgaaauugacuuugagcaacggaagggccaguucuacccgaauaaggagcccaaaaucgcuuauuacccugaacaggucgccagcaagguuaaauaucaguuucuguucaaguccagcuuucucgagaugguggaagauuucaaacgcagaggcuacaacggggccauucccuacgacuggacaaucuauuaccugcggaagaaggcucuugagaaaaagauugagaaagaggagcuggccuggcuccugcuuaauuuuaaccaaaagcgcggauauuaccagcugagaggcgaagaggaagauaccaauucuaacaaaaaggaggaguucuaugaacucaaaguguccagcgucgagcagacacaugacaccucuccuuccgggacgugguacaaugugcaucugcagaacggauggguuuaucggcgcaagagcaaggauucucugaaagacugggaaggccucaauaagaaauuuaucgugaccacacaccugaacgcugauggguccgagaaacuugacaaagauggaaaugucagcagauccuuccgggcccccaaggaagacgacuggggccuggugaagaaaagaaccgagucuguucucgaaaagagcggccugcacgugggggaauuuauuuacgagucccuucuggaaaacccugagcaaaagauccgcggaagccucaucaagacaauugaacggaaauacuauaagaaggagcuggaggcgauccuggauaaacagaccucuuuccacagagaacuccgcaaugacgcccuguacaaggaggcuacgcuugaacuguauccgaaaaacuccgcccaucggagcaacauuaagcagagaggcuucaaauaccucuuuaucgaggauauuaucuucuaucaacgcccccugaagucucagaagcaccuuaucgcucauugccaguacgagaaacggacauauaagaauaacgggggagaaaccauugaggucagccugcagggcgccccuaaaucccaccccucuuuucaagaauuuagaaucuggcaguuuauuagcaaucuccgcuucuacgacaaggaggaaaucguggaggggcaggagguguccauuacagaaaaacugcucaagagcgauucugacuuugcggagcuguaccacuggcugucccaucagcgggaagucgaucaaaacaaaacccuuaaguauuucacccagaagaaacugaucccuaagcagaaaaaggacaaucccacaaucagauggaacuuuccggaggauaaaaaguacgaaaugggagaguucaaggcccagcuccugagccgccuggagaaaguucggaauugucaaccugacaaguuucuuacgcagaaaaacgaacucgaucuguggcacauuaucuauucugugaccgacaagacagaguucgaaaaagcucuggugaccuuugccgagaagagagaacucgacuccgagagcuucgucgagaauuucaagaaauuucccccuuucaagaacgauuacgcuuccuauucucugaaagccauuaagaaaauccuuccccugaugcggcgcggcaaguacuggaaggccgaaaaucucggcccccagacacugcagagaauugagaaaaucgugaacggggaagcugacgauaagauuagcauccgggcgagaaaacuggcccuucaucucaaugacaccaaguccuuucaaggacugccuacgucucuggcuugcuauguugccuacaaccgccacagcgagaaugaggaaaaccagaaauggcagacaccguccgauaucgacaaguaccucaaagauuucaagcaacauagccugcggaaccccauuguggagcagcuuaucaccgaagcccugagagucgugcgcgacauuuggaagcacuauggccaggggcagaaagauuucuucgacgagauccacguugaacucggaagagagaugaagaauccugcuauuaaacggaagaaacugucucaaaagauccaggagaacgaaaauaccaacuaccgcaucaaggaggugcugagaaaucuuaaagaaaacaauauugaugccaagcccuauuccccuagccaucaggagauccucaaaauuuacgaagagggcgucuaucagucuaucgagaacguggaagacgagauugaaaagauccggaaaaauaacacacccuccagcaaggauaucaaucgcuacagacuguggcuggagcaaggguauauuucuccguacaccggcgaagucaucccucucagccagcuguuuuccaaccaguacgagauugagcacaucauuccccggagccgcuucuuugacgacucucuugcgaauaaggugaucugugaauccagcguuaacgcucugaaagauaauaagacagcccucgaguucaucacgaaccauggaaacgaaaaaguggaguuugccggcaagaccgucgagauucuguccucugacaaauauacagaacacugcaagagauacuucaagcggaaucgcaccaaacugaagaaccuucucagcuaugaugugccugagggguuuaucaauagacagcugaacgacucccgguucauuucuaaauacguuagaaaucugcucagcaacaucgugcgcgaagaggaggaacgggaggcuauuuccaagcacauccugacaauucccggaucuaucaccagccaacuuaaacaggauuggggccugaaugaaaaguggaacgaggucgugacgcauagauucgaacgccucaauaaccugaccgggacaaccgacuuuggauucugggauaauaagaucaacgccuuucggauuacagugccuaaagagcuguccaagggcuucaauaaaaagagaaucgaccaccgccaucacacccuugaugcucugguuauugccgcguguacgaaagaccaugucaacuauaucacaagccucaauaccgaacggaacaaccacucucugguguccaagcucagaaauaccaaaaaggugcugauuaacgggaaggagcgccggaucgccaaggcuuacaaacuucccuggagcucuuuuccgcuggaugccaaacaccagcucgagacaaccgucaucuccuucaagcaaaaucugagagugauuaacaaaagcucuaauaagacauggcaguggcggaacguuaauggcgaacagaagaaaaagcugaucccucagacgaaaggagacuccugggcuauucgcaagagcaugcauaaagccaccguguccgcgaaggucgagagcgugggcaaggggaaaaucaagacaaccaacagaacaccccuuggagaaauuaaaggcgagaagcacguugagaaaaucuaugaugcccggauccgcgaagugauuauccccaaucaucugaacaaguaccucgacgagaaggggaaaccuaauuacgaagcugccuuuucucaaagcggaauuaagcagcugaacgagaauaucgaaguccucaacgagggcaaaccgcacgcucccauuuauaaggugccucuguucgagguuggguccaaauuucccgugucugaagacgccaagagcccuaaaaaucagaaguacgucgaggccgauaagggcaccaaccuuuucuuugcuguguauuggaaugaagagaaacagaagagaaacuucgaaacggugccccugcaucaagucaucguucaccagaaacagguggcgucccucccuacagagcagcggaccucugugcccauuaagccggagcugggacuguuccuuuuuagccuguccccuaacgaccucgucuacgugcccaccgaagaggaaaucgagaauccucaccugguugaucucaaaaaccugucuaaggaccaaacaaauagaaucuauaagauggugagcuccaccggcaacgaaugccauuucauuccccaccauaucagccgccuuauuaugaaauacaaugccaagcagaaagucggggaguuuggaucucugaacaaggcugagaaagccaucacaggcgaaacgauuaaggagaagugucugaaaauccagaucaauucccucgggaagcugaaaaccgaacggauugccuga

SEQ ID NO: 4546 - RNA, 4380 nt, Artificial Sequence
  Cas9 variant
augaaguucaaccugggccucgacaucgggaccaauagcauuggaugggcccuggugaacgaggauuacgaaaauaaaaagggcaaaaucauugcugccggguccagaaucauucccaugacacaggacauccuugauaaguuuggaucuggcgcgaucacggagacccaaacagcucugcggaccgacuaucgcagcaaaagaaagcucauucagcgguuccugcuucgcagagaacggcugcaccgcguccucaacguucuggauuuucugccuaagcauuacgccgaguccaucgacuucgaaaaauauuuugggaaguuccucccgaauacagagcccaaacuggccuacaaccagaaucaguuuauuuuccaaaacucuuuucuugagaugcugaaggaauuucaggagaaacacccugaacuccugaccaauaacaagaagauccccuaugauuggacaauuuacuaucuuagaaagaaggcucugaaucagcggaucgagaaagaggaacucgccuggcugcugcuccaguuuaaccaaaagcgcggauacaaucagcugagagacgaggaagaggaaagcgugccuaacaaacagguggaguucuacucccuuaagauuaucgaugucguggcugaccagcccaaagagggccgggauaagcgcugguauucuaucaaucuggaaaacggcuggaccuacagacgggagagcaagacgccucucuuuaacugggaagggaaaaccaaggacuucauuguuacaaccgaucugaaucaagacggauccaucaaaaaggacaaagagggcaaggaaaagcgcagcuucagagccccgucugagggggauuggacacuucugaaaaagaaaaccgagaaggaaauuuaugaguccggaaaaacgcucggcacauacaucuaugacgcgcugcugaacacccccgaucucaagauuaagggggacuuuauccggacaaucgauagaagcauuuacaaagaggaacugcagcagaucauuaauaagcaaaaagaauaucaucuugagcugaacucuuccaagcucuacaaagccugccuggaggaacuuuacccuaagaaugagaucuauaagagcgcucugaaaaacaaggacauugccuaccucuucaucaaugauauccuguauuaccagcgcccccugaaagcuccuaaguauaacauuggaaaauguaccuacgaaucucggaccuuuaagaaagaggacaagaagaucagagaguauauucccgccguggcgaaaucccacccccucuuccaggaauuucgccuguggcaguggaucaagaaucuuaaaauuuacgagaagcugagcuccgauaacugcacagacuucuuucucacgaaugaacaagauuucgagaaccuguuugaguuccuguggaauaaaaaggaaaucgaccauaagggcauucuugaguaccucgucaaaaccaaguuuccugaccugaaacccaaacaggugaaaacaaagguuaaggaauaucgguggaacuacguguaugaucacgagaaagacgaaucuaagaccuacccuuguggcgagacauauuuccugcucaaaaauaagcuggauaaaaucuacaacgcccaggacgauuuucuugacaaggaaagacuguauaaccucuggcacaucauuuacagcgucaccgauaagaaacaguacgagaaggcucuggccaaauucgcucugaagaaucaucuugacacgaaauccuucgugaacacauuuaagcgcaucccgcccuucaaaaaugauuaugccauuuacagccucaaggccaucaagaaacugcugccucucaugcggguggggaaguauuggaacuacgacgauauugacccgaucaccaaacaaaagauccagugcauuaucaccggagaggaaaaugauacaauuucuacccuggucagagagaaaacaaaccacuuuuccaaugaaaacgacuucaagaaucuuccccuguggcucgcuggcuauaucguuuacaacagccauaaugagucuagcgaaauugagaaguggaaauccccucaggacaucgauacguuucugaagaaauucaagcagcacgcgcugcgcaaccccaucguggagcaaguggucaccgaaacacuucgggugguuagagacauuuggucuaaaaaggggcagggaaagaaagauuucuucaaugagauccacauugaacucggcaaggaccugaaaaacccuguggauaagcgccggaaacugagcuccaccaauacaaagaacgagagcaccaacacgagaaucaaggcccuccugauugagcuuuuuacccagggggucgaaaaugugaaacccaacucuccgaagcaucaggagauccugaaaaucuucgaagagggagcucucaauuccggcauugaaaucgaggaggacauuaucaagauuagcaacacagaucaaccuaccaaaaagcagcuggaacuguauauccuuuggcucgagcacaaguacaaaucucccuacacaggccaguccauuccucugagcaagcuguuuacccccaauuaugaaaucgagcauaucauuccucgguccaaauacuaugacgauaaccucucuaauaagguuaucugugaaacggagauuaaccgccugaaaaauaaccaacuuggguacgaguucaucaauaaccacgaaauuagagaggugacacuggaagagggaaagaccauccggcuccugagccccgaacaguauuggaauuuugucacaaccuacuaugccaaaaacaaggccaagagagagaaucugcuucugaaagagcucccggugcagauggucgaaaagcagcugaacgacacccgcuacguguccaaauacguuaugcaacuccugucuaagaucgugcggaaagaggauggcacagacaacgggauuaauagcacgaacauccuuuccauuagcggaaagaugaccagagcucugaagaaugauugggaccucaacgacgucuggaaugaucugcugcuuuaucgcuucgaaagacugaacacaaucaccaaaacaaaucucuucaccacguacucugagcagaagcagaaacggaugccuauugugcccgaccaguaugccaagggcuuucauaaaaagcgccuggaucacagacaccaugcgcucgacgcuaucguuaucgccugcauuacacggaaccacaucaauuacaugaacaaucaaaacauucagggggagaagcugaaaaagaaugccaucgaaaaagagaacuaucgcgaaauucuucagaaguccagacuggauauccgggcucagcucugugagaaaaaguacaaugacaacgaucccaccaaguauaauuggguguucauuaaaccuugggccgacuuuaccgaaaacacaaaggauauccuggagagcaucauuccgucuuucaaacaaaaccugcgcaucauuaauaagaccgucaacuacuacgagaaauauaaugaaaacggcaagaaagugaaggugagacagaucaagggagacaauugggcuauucggaaaccccuucauaaggagacaaucuccggcaaaguucaccugagcuacaagacgccugccaaagggaagauccucaccgcgacacgcaagguccuggauucuagcauggacuuuaaauccauugaaaagaucaccgacacaggcauucagaaaauccucaagaacuaucuggaguacaaaaagagccccgaacuugccuucucuccugagggaauugaggaacugaaugcuaccaucacgaaguauaacaauggguuucaccauaaacccaucuacaaggugagaauuuaugaggaaggagugaaauucccucugggcaacaaggggaauaaaaaguccaaguacgucgaggccgaaaaaggcaccaaccucuuuuucgcuaucuacaaggaucaagagaauaaccgguauuuugagacaauucccuucaaugacgugcuggaaacccuuaaaaagggaaugagcgccguuccggagaaaaaccaggaagagaacacacugguguucgcgcucuccccucaggaucuggucuuugugcccacccucgacgagaucgaaaauccugauauuguugacuucaagaaccugacaaaagaucagaccaauagaaucuacaagauggugucuagcuccggcaagcaaugcuuuuucauuaaagccgaggucgcuacgucuaucgugaacaagauggaauuuagcacauccaauaaaauggagaacucuaucgaagggauucagaucaagagcaauuguuggaaacuuaagcuggaccgccugggaaccauuacccggguuaucaaguga

SEQ ID NO: 4547 - RNA, 4383 nt, Artificial Sequence
  Cas9 variant
augaccaaguucaaccugggccucgacaucgggacaaauagcauuggaugggcccuggugaacgaggauugcgaaaauaaaaagggcaaaauccuugcugccggguccagaauuauccccaugacgcaggacauucuggauaaguuuggaucuggcgcggcuaccgagacacaaaccgcccuccggacagacuaccgcagcaaaagaaagcugauccagcgguuccuucugcgcagagaacggcuccaccgcguccugaacguucuggauuuucucccuaagcacuaugccgaguccaucgacuucgaaaaauaccuggggaaguuucuuccgaauaccgagcccaaacugguguauaaccagaaucaguucauuuuucaaaacucuuucuuugagaugcucaaggaguuccaggaaaaacacccugaacuguuucuuaauaaccagaagauccccuacgauuggacaauuuauuaccugagaaagaaagcucucagccagaagaucgagaaagaggaacuggccuggcugcuccugcaauucaaucagaagcggggauauaaccagcuucgcgacgaggaagaggaaaauaccccugauaaacugguggaguuuuacucccucaagauuaucaaagucacggcugacgaggccaaggaaggcauuaacaagagaugguacucuaucaaucuggagaacggcuggaucuaucggcgcgaaagcaaaacaccccuuuucaacugggaggggaagaccaagaauuucauugugaccacagaucugaaccaggacggauccaucaagaaagauaaggaaggcaaggagaaacggagcuuuagagcgccuucugagggggacuggacccuccugaagaaaaagacggaaaaagagauuuacgaauccggaaagacacugggcaccuauaucuacgacgcccuccugaauaacccggaucuuaagauuaaaggggcucugaucaagacaaucgaccgcagcauuuauaaagaggaacuccaacagaucauuaauaagcagaaagaguaccauucugagcugaacaauuccaagcuguauaaggccugucuugaggaacucuaccccaaaaacgaaaucuacaagaaugagcugaaaaacaaggauauugcuuaucuguucaucaaugacauccucuacuaucaaagaccucugaaagcccccaaguacaacauuggaaaaugcagcuaugagucucggaccuuuaagaaggaagauaaaaagaucaccgaguucauuccugcgguugccaaaucccacccccuuuuucaggaguucagacuguggcaguggaucaagaaucucaaaauuuacgaaaagcugacaaacgacaauuauacggacuuuuuccugaccaacgaacgcgauaucgagaaacuuuuugauuuccucuggaacaaaaaggagauugaccauaaaggcauccuggaauaccugaucaagacaaaauuuccggaucucaagccuaaacaggugaaaagcaaggucaaagaguaccgguggaauuauauuuacgaccacgaaaaggacgaguccaaaaacuaucccuguggcgaaaccuacuuccugcuuaagaauaagcuggauaaaaucacaucuauucaagacgauuuucucaacaagaaaagacuggagaaucuguggcacaucauuuauagcgugaccgacaagaaacaguacgagaaggcucuugccaaauucgcucucaagaaccagcuggauacgaaguccuucguuaauacauuuaaacgcaucccugccuucaagaacgacuaugccaucuacagccugaaagcuauuaagaaacuccugccccuuaugcggguggggaaguacuggaauuaugaugacaucgaucccauuaccaagcagaaaauccaaugcauuaucaccggagaagagaacgacacaaucucuacccuggucagagaaaagacaaaucauuuuuccaacgagaaugauuucaaaaaccucagccuguggcuggcgggcuacauuguguauaauucucacaacgaaagcuccgagaucgagaaguggaaaucuccucaggacauugauacguuucuuaagaaguucaaacagcaugcccuccgcaacccgaucguggaacaggucguuaccgagacacugcggguggugagagacauuuggcugaagaaagggcaaggaaagaaagacuuuuucaaugaaauccacaucgagcucggcaaggaucugaagaaccccgucgacaaacgccggaagauuagcuccaccaauagcaaaaacgagacaaccaauaucagaauuaaggcccuucugaaagaacuccugaaggaggggaucgaaaacauuaagccuaauucucccaaacagcaggagauccugaagauuuuugaagagggaauccuuaacuccggcaucgauauugaggaagagaucauuaaaaucagccagauugcucaaccuacgaagaaacagcuccaguacuaucgcaauuggcuggaacaaaaguacaucucucccuauaccggccaguucaucccgcuguccaaacucuuuacaagcaaguacgagauugaacacaucauuccucgguccaaguacuaugacgauucucugagcaacaaagugaucugugagaccgagauuaauagacuuaagaacaaucagcugggguacgaguucaucaacaaucaugaaauccgggaaauuacacucgaggaaggaaaaaccauccgccugcugucccccaagcaguaucuugacuuuguuacgacauacuauggcaaaaacaaggccaagagagagaaccugcuccugaaagagauuccuauccaaaugauugaaaaucagcucaacgauacccgguacgugucuaaguaugucaugcagcugcuuagcaaaaucgugagaaaggaggacgggacagauaauggaaccaacuccauuaauauccugagcguuucuggcaaaaucacccgcgugcucaagacagacugggggcugaacgaugucuggaaugaccugcuuugcuaccgguucgaaagacugaacaagauuacgaauaccaaccucuucacaaccuacuccgagcagaaacaaaagaucauucccaucgugccugaucaguaugcuaaaggcuuucacaagaaaaagcuggaccaucgccaccaugcccucgacgcgauucugaucgcuuguaucacaagaaaucacauuaacuacaugaauaaccagaauauccagggagagaaacuuaagaacuucaagauugauaaacacaauuaucaugaaaucuuucaaaagagccggcuggacaugcgcgcccagcucugcgagaaaaaguacaacgaucacgacucuaccaaauauacgugggucuucacaaagcccugggccgauuuuaccgaaaacauuaaggacacccuggaguucaucaucccguccuuuaaacagaaucugagaauuaucaacaagacagugaauuacuaugaaaaauacaacgagaauggcaagaaaguuaaggugcggcaaaccaagggggauaacugggcuauucgcaaaccucuucauaaggagacaaucagcggaaaaguccaucugcucuacaagacgcccgccaaaggcaagauucugaccgcuacaagaaaggugcucgacucuagcauggauuucaaauccaucgaaaagauuaccgacacagggauccagaaaauccugaagaauuaucuuaaauacaaggagagccccgaacuggccuuuucuccugagggaauugaggaacugaacaucaccauugcgaaguauaaugauggcuucuaccacaaaccgaucuauaagguucggauuuacgaggaaggggugaaauuuccccucggcaaccgcggaaauaagaaaaacaaguaugucgaggccgaaaaaggcacgaaucuguucuucgcuaucuacaaggaccaggagaacaauagauacuuugaaaccaucccuuucaacgacgugcuugagacacugaagaaagggauguccgccgugcccgagaagaaccaggaaaagaauacccucguuuuugcucugagcccucaagaucucgucuucgugcccacacuggacgagauugaaaacccugauaucguggacuuucggaaucuuaccaaggaucagacaaaccgcauuuauaaaauggucuccucuagcggaaagcaguguuucuuuaucaaggccgagguggcgaccuccauuguuaauaaaauggaguucacgacaucuaacaagauggaaaauagcaucgagggcauccagauuaaauccaacugcuggaagcugaaacuggacagacucgggaccaucacccgggugauuaaguga

SEQ ID NO: 4548 - RNA, 4389 nt, Artificial Sequence
  Cas9 variant
augaccaagaacauccugggccucgaccuggggacaaauagcauuggaugggcccuuaucaaacagaacuucgagaauaagcaaggcgaaauucuggggaugggauccagaaucauucccaugucucaggauauccucggcgacuuugggaaaggaaacagcgugucccagacggcugagcggaccaaguaccgcucugucagacggcugcgcgaaagauuccuucugcggcgcgagagacuccaccggguucugaaucugcucaacuuucugccucagcauuaugccagccaaaucgauuucgaaaaacgcuuuggcaaguucaagguggagacagagccgaaacuugcguggaagaauauugacggccaguuuuccuuccuguuucagaccucuuucaacgaaaugcucgaggauuuuagagugaaugggcaggacgucaaaauccccuacgauuggacaauuuauuaccugcggaagaaagcucuuagcaagaagaucgaaaaagaggagcuggccuggauucuccugaacuucaaucaaaagcgcggauauuaccagcugagaggcgaagaggaagaggaaaacccuaauaaacucguggaguuuuauucccugaagguuguggacgucguggccgaugagccccagaaagggaaguucgacaucugguacagccuuauucuggaaaacggauggguuuaccggagaucuuccaaaaucccucucuucgauuggaaggacaagacccgcgauuuuaucgugacaaccgaccugaaugacgauggcagcauuaaaaaggacaaagaugggaacgagaagcggucuuucagagcucccuccgaaaacgacuggacgcuugucaaaaagaagaccgagcaggaaaucgagcaaagccgcaaaacagugggaaccuauauuuacgaggcccugcucgauaauccuaagcagaaaaucaagggcaaacuggugcggacaauugaaagaaaguuuuauaaggaggaacugcgccagauccucgagaaacaaaaggaauuucaccaggagcugcagucugacgaucuuuacaacgacugcguccgggagcuguauagaaauaacgaagcucaucagcucacccuguccaaaaaggauuuuguucaccuucugauggacgaucucaucuucuaccaacgcccgcugcggagccagaaauccucugugagcaauuguacgcuggaguuuagaaaguauaaggacgaaaacggcgccgagcauacacaguaccucaaagcgauucccaaguccaauccuuacuaucaggaguuccgccuguggcaauggaucuacaaccuuaauauuuaucggagagaagacgagcagaaccccaucaccggggaauuucugagcacaaccaaagaguucgaaaaucucuuugaguuccugaacacccgcaaggagguggaucagaaagcccugcuuaagcacuuuaaacucaaugacaagacacaccgguggaacuucgucgaagauaagaaauacccuugcaaugagacgaagaccaugauuucuuccagacuggaaaaaguggagaacaucagcgacgauuuccugacacgggaaaucgagcagaagauuuggcauaucauuuauucuguuaacgacaaaaucgaguacgaaaaggcucucaagagcuuugccaaaaagcaccaucuggaugaguccucuuucuuugaggcuuuccgcaaauuucccccguucaagagcgaauauggauccuuuagcgaaaaagccgugaagaaacuucugccucucaugagacugggcaaauacuggaauuacgcggacauugauaagucuuccaaagagcggauccaaaagauuaucagcggggaguaugacgaaaacaucaaagauagaguccgcgagaagucugugcaccugaccacagaaaaugacuuccagggacuucagcucuggcuggcccaguacauuguuuauggccggcacuccgaggcuagcaugaucgggaaguggaacuccgccgaugaccuggaggaauuucucaaaaauuucaagcaacauucucugagaaaccccauuguggagcaggucaucaccgaaacgcuucgcguggucaaagacauuuggcugaaguacggaaauggcgcuaaagauuucuucaacgagauccacaucgaacucggcagagagaugaagcugccugccaaagagcgggaagaccugacacgcaagauuaccgagaaugaaaacaccaaucuuagaaucaaggcccuccuggcugagaugaugaacgauagcuccguggaaaauguucggcccuuuucucccaugcagcaagagauucugaaaaucuaugaggacggggugcucaacagcggaauugaaaucgaggaugaauaccugaagaucuccaaaacagcgcagccuagcccgucugaccuuaagcgcuauaaacuguggcucgagcagaaguacaagucccccuacaccggccagauuaucccucugaauaaacuguucacacccgaauaugagauugagcauaucauuccucaaagcagauacuucgaugacucuuuuuccaacaagaucaucugugaaagcgccgucaacaaacuuaaggauaauuauauugggcucggauucaucaaacaguuuggcgggacgauuaucgagcugggcuucggaaagucugugaagguuuuugaaaccgaggaguacgaagacuucgugaaaaagcacuaugcuaacaaucggagcaaacgcaacaagcugcuccuggaggauauucccgaaaagaugaucgagagacagauuaaugacacacggcauaucuccaaguacaucagcggcguccuuucuaacauugugcgcaucgaugacgaccaggccaagaaaauuaucgaagaugccgagauucuggcuagaaaggagaucgacaaagauaaggccaaugaaauccggagaaaagcgaagucccucgcuaccgacgaugggauuaacagcaagaauaucgugccgggaaacggcaaaauuacaacccaacugaagcaggacugggggcugaaugauguuuggaacgaccuuauccugccucgcuuugagcggaugaaucagcucacgaacuccaaagauuucaccgucuggaaugaaaaccaccagaaguaucugcccacagugccuauugaguuuucuaaaggauucagcaagaaaagaaucgaccaccgccaucacgcccucgaugcccuggugaucgcuugcgccaccaaggaccaugucaaccuucugaauaaccaauccgcuaagucugacacaaaacgguacgaucucaagaaaaagcugaugaaauuugaaaaggugguuuaccaccacacccagacgggcaauaagauugagagagagauccccaaacaguuccugaagccuugggaaaacuucacauuugacgccaaauauaaucuugagagcauuaucguguccuucaagcaaaaccugcgcgucauuaauaaagcgaccaacuacuaugaaaaguacguggagaaggaugggaccaaaaauaagggccggguugaacagacaggaaccaacugggccaucagaaaacccaugcauaaggacacagugucuggcaaagucaaucucccgugggugaagguuccuaaggggaaaauucugacggcuacccgcaagauccucgauaccagcuuugaccugaaauccaucggaagcauuacagauacaggcauccagaagauucuucggaacuaucuggaguucaaagggucucccgagcucgccuuuucccccgaaggaaucgaggaccugaauaagaacauugaaaaauacaaugauggcaagccucaccagccgaucaacaaggugagagucuucgagcuggggagcaaauuucaagugggccagaccggaaauaagaaagacaaguauguggaggcugccaaaggcacgaaccuuuucuuugcggucuacgaagauaagaacgggaagcggucuuacgagacaaucccccugaaugaaguuauugagcgccagaaacagggacucuccgugguggaccugaagggcaccaacgauuucuaucucuguccuaaugaccuggucuacauccccagcgacgaugaacuugagaacauuaauaacaucgacuuuaaaaauauugccaaggagaaaaacgaaagaaucuauaaggugguuucuuucuccgggagccaaaucuuuuucgugcggcaggauauugcuaccuccaucgucaauaaggccgagcugagcacacugaacaaaauggaacgcgcuauggacggaucuaugauuaaggagagcugcgugaaacucaauguugauagacugggcaacaucuccaaggccuga

SEQ ID NO: 4549 - RNA, 4401 nt, Artificial Sequence
  Cas9 variant
augaccaagaacauccugggccucgaccuggggacaaauagcauuggaugggcccuuaucaaacaggauuucgagaacaagcaaggcgaaauucuggggaugggauccagaaucauucccaugucucaggacgugcucggcgaguuugggaaaggaaauagcgucucccagacggcugcccggaccgauuaccgcggcguuagacggcugcgcaagagauuccuucugcggcgcgaaagacuccaccgggugcugaacgugcugaauuuucucccuguccauuaugcgucucagaucgacuucgagaaacgcuuuggcaaguucaaggaagauacagagccgaaacuggcuuacaacaaggagggguuuaucuucaaaaauagcuuugaagagaugguggccgacuucagaaagcaccaaccccagcuucuggaaaacgauaaaaagauuccuuaugacuggaccaucuacuaucuccggaagaaagcccuguccaagaaaauugagaaggaggaacuugcuuggauccugcucaauuuuaaccagaaacgcggauacuaucagcugagaggcgaggaagaggaagagaaucccaacaagcugguugaguucuacucucucaaaauuacagaugugcuggccgacgaaccucaaaagggaaagagcgauaucugguacucccuuauucuggagaauggguggaucuaucggcgcagcucuaaaacaccccucuuugacuggaaggaaaagaccagagauuucaucgucaccacggaccugaacgacgauggcuccauuaagaccgacaaagaugggaaugagaagcggagcuucagagcuccuucugaaaacgacuggacacuugugaagaaaaagaccgagcaggagaucgauaaaucccagaagacaguuggaaccuacauuuaugaaacgcugcuccagaacccgaaacaaaagaucaagggcaaacuggugugcacaauugagcgcaaguuuuacaaagaggaacugaagcagauccucgaaaaacagaaggaguuccaucaagagcugcagaaugacgaucuuuauagcgacuguguccacgaacuguaccggaccaacgaggcccaucagcucacacugucuaagaaagaaaucgugaaucuuuuuauggaggaucugauuuucuaucagagaccccuccgcucccaaaagaccagcaucuccaacugcacccuggaguuucggaaauacaaggacgaaaauggcguggagcacacacaguuccugaaagcgauuccuaagucuaaccccuacuaucaggaauuuagaaucuggcaguggauuuucaaucucaacaucuacaaacgcgaugacgacagcaaugucacgaaggaguuucugaacaccacagaagauuucgagaaucuuuuugaguuccugaacaaucggaaggaaguugagcaaaaagcccuccugaagcacuuuaaacugaacgaaaaacuucauagauggaauuucguggaggacaaaaaguauccuuguaacgaaaccaagacaaugaucuccacccgccucgauaaaguggagaacauuagcaaggacuucuuuacgcgggagaucgaacagaaaauuuggcacaucauuuacucugucaaugauaagaucgaguaugaaaaagcucugaaguccuucgccauuaagcauaaccuggacgagaauagcuuuuucgaggcuuuuaaaaaguuucccccguucaaaucugaauacgggagcuucuccgagaaggccaucaaaaagcuccugccucuuaugagacugggaaaguauuggaacgaagaugagauccucaaauacucugacgauuacuuuaagaauauugaaagccugcugggcgugcuuaaacagcgcgacgagaacaucuccgaugcggaccgggagaauuauaacaagacaauuaauaacaaacucagagccgaacuggagaauuuccagaacgcugaaaucgagagcuuucaagggcugcggcuccacauugcccaguacauccuguauggaaagcacucugaaggcgauaauaaaaaguucaacuccgcugacgaccuugagaaguuucugaaagaguucaagcagcauagccuccgcaaucccaucguugaacaggugauuaccgagacccugagagucgugaaagauaucuggacaaaguacgggaacggagccaaagacuucuuugaugaaauucacaucgagcugggccgggacaugaagaagaccagagaugaacgcgccgacgcuacaaaaauuaucacggagaacgagaauaccaaccuucggaucaaggcgcuccuggccgaaaugaugaaugauguugagauggaaaacgugagaccuuauucucccaugcaacaggagauucugaaaaucuacgaagacggcauucucaaguccgauaucgagauugaggacgauauccugaaaaucagcaagacagcucagcccuccucuagcgaccuuaagcgcuauaaacuguggcucgaacaaaaguacaaauccccuuacaccgggcagauuaucccgcugaauaagcuguucacacccgaguaugaaauugagcauaucauuccucagucuagauacuuugaugacagcuucuccaacaaaaucauuugcgagagcgccgucaauaaacuuaaggacaacuauaucggacucggcuuuaucaaacaguucgggggaaccauuguggaauguggcuuugggaagaaugucaaaguguucgaggccgaagaguacgaagauuuuguuaagaaacacuaugcuaacaaucggggcaagcgcaacaagcugcugcucgaggagauccccgaaaagaugauugagagacaaaugaaugacacgcggcauaucucuaaguacauuuccggagugcugagcaacaucguccgcguggaagauggcucugacgaggggguuaauuccaaaaacaucgugccuggaaacggcaagauuaccacacagcuuaaacaggauugggggcugaaugacgucuggaacgaacucauccugcccagauucgagcggaugaaucagcugaccaacagcacagauuuuaccgccuggaaugagaaccaccaaaaguuccuuccgacggugccuauugaguucucuaaaggauuuagcaagaagcgcaucgaccacagacaucacgcgcuggaugcucucauuaucgccugcgccacaaaagaccaugugaaucugcucaacaaucaguccgcuaagagcgauaccaaacgguaugaccugaagaaaaagcugaugaaguucgaaaaaguugucuacaaccacccccagacaggcgaccgcaucgaaagagaggugccuaagcaguuucuuaaacccugggauaauuucaccuuugaagccaagaacaaucucgacaaaauuaucgugucuuucaagcaaaaccugcgggucauuaauaaggcuaccaacuacuaugagaaauuuguggagaaggaugggguuaaaacaaaggaaagaguggagcagaaaggcacgaauugggccauccgcaagucccugcacgaagagaccgucagcggaaagauugaccuuccuuggguggagacaaacaacggcgaguucaucaccgcgacacggaaaucccuggaugccucuuuuaaucucgaaaagauuaaaaagaucaccgacacggggauccagaaaauucugagaaacuaccucaaggcuaaagaugacaaugccgaacuggcuuucagccccgagggaaucgaagaucuuaacaagaauauugagaaguauaacgacggcaaaucccaucaaccgaucguucgcgugcgggucuacgagaaggggaaaggaagauuugcccugggccagacagggaauaacauugauaaguaugugcagggcucuccuaaucucuucuuugcgaucuacaaagacgaaaacggaaagaaaagcuaugaguccauccgccuggauauuguuaucgaacggaugaaacagggccugcaagccgugcccgagaccaaucccaacgggauuucucuuuaccagaaucugagcccucucgaccuggucuacaucccgaccgaagacgagauugagagcccccaccucaucgauuucacaauccugaacaagaccagacuugaacgcauuuauaaugugaacgacuucuccggauacacaaucuauuuuucucagaacuccuucgcuaaaaauauuuacccuaaggagauggauaugacguggaacgaaaagaagcagaagcccagcggcucuuuugacuccaaaaccgccagcuauaauaagaaaucuaucaaggauauuuucaucaaacugaagauugaccggcuggggaacaucuccaaggugagcaauacacucuga

SEQ ID NO: 4550 - RNA, 4401 nt, Artificial Sequence
  Cas9 variant
augaagaacauccugggccucgaccuggggaccaauagcauuggaugggcccuugugaaagaggauuucgaaaacaagcagggcgagauccuggggcucggauccagaauuauccccaugucucaagacauucugggcgaauuugggcggggaaauagcaucucccagacagcugaucgcacgggcuacagaggcguccggcgccuuagagagcggcaucugcuccgcagagaacggcugcaccgcguucugaacauccucggguuccugccuaaucacuaugccaaagagauugacuuuaccaagagacuuggaaaauucaucaaccaugcggagccgaagcugucuuuugauaaggaguucauuuuuaaagacagcuucaaugaaaugcucaaggauuuucagcagaaccaacccggcuucaucauuaauaaacacggggaagaggcucuggugccuuacgacuggacaaucuauuaccuucggaagaaagcccugacccagaagauugauaaggaggaacucgccuggauccugcugaacuuuaaucagaaacgcggauauuaccagcucagaggcgaggaagaggaagagaacacaaauaagcugguggaguucuauucccuuaaaaucauugacgucaucgcugauaacgaagugaauaagaaaggggagguuugguacucucugcaucucgaaaacggauggauuuaccggcgcagcuccaagaucagccugguggacuggaaagauaaggucagagacuuuauugugaccacagacguuaacgaugacggcucugagaaacuugauaaagacggcguggucaagcgguccuucagagcccccagcgcugaugacuggacccugcucaaaaagaaaacggaacaagauaucgacaauucuaacaagaccgugggggccuauaucuacgagaaucugcugcucaacccuaagcagaaaauuaagggaaaacuggugcgcacaaucgagcggaaguucuauaaagaugaacuuaagcagauucuggagaagcagaaagaauuucaccaagagcuccagaaugaacagcugcuucaagacugcgucagagagcuguacaaguauaacgagcagcaccagcagaugcucgaauccaaagauuucguucaucuguuucugaaugacaucauuuucuaccaacgcccccuccggagccagaagucucugaucuccaacuguacccuugagaaaagagugagccgcgacggcguggucuuuccuaucaaggugauuuccaagucuaauccguauuaccaggaguuccggcugcuccaguggcugcaaaaccuggcgaucuacagaaaagaugacgauguuaaugugacacaggaauuucuuaacagcauugaguccugggaaaaucuccugcaguuccugaacgccaagaaagagaucaagcaggaacaacucauuaaauuucugcuugagcagaaggggcugaaaggaaauagccucaagaccgcuauccugacguaucgcuggaacuacgucacagacaagguguaucccaugaacgaaacccggucucugauucaggauaaacuuaagaaaguugagaauguggccacagacuuccucuccuuugauaacgagauggcucuguggcacaucaucuacagcgucaaugacaagauugaauaugagaaagcccuggcgaaguucgccucuaagcauaaccucgaugaaaucagcuuuguggaguccuucaaaaaguucccucccuuuaaaucugacuacggcagcuucuccgaaaaggcuauuaaaaagcugcuuccucugaugagauuugggagcgucuggaauaagaacaauaucgugcccucuguucucgaucgcauugacaaaauccugaccggagaguaugaugagaagaucaaaauucgggugagagaaaaggccgagcaguuccaacugaaccagaucgaagacuuucagaaucuuccgcucuggcuggcucaauacgucguguacgaccggcacuccgaggccgaaauugccggcaaauggaacagcguuaaggaucuggagaauuaucucaaggaguucaaacagcacucucugcgcaacccuaucguggaacagauuaucaccgagacacuuagagucgugaaggacaucuggcagcaauacggcaauggggugcagaacuuuuucgaugaaauucauaucgagcugggacgggagaugaaaaauacggcugacgaaagaaagcgcauuaccaacuccguuacagagaacgaaaauaccaaccuccggaucaaagcgcugcuggucgagcuuaaggaagauacaaauauugagaacgugagaccccacagcccuaugcagcaggagauccucaaaaucuaugaagagggcgugcugaaugccgucgaaaacauugacgaggauauccugaagauuuccaagaccgcucaacccucuaaaagcgaacucauccgcuacaagcuguggcuugagcagaaauaucagucccccuacacgggggagaugauuccucugucuagacucuuuacaagcgacuaugaaaucgagcaugugauuccgcagucccgguacuucgaugacagccugucuaauaagguuaucugcgaagccgccgugaacaaacgcaaggauaaucaacugggacuugaguuuaucaagaaccaccauuccgaaaagauugagcugggcaaugggagaaccgcucagguccucgagguggaagccuacgagagcuucguuaagaaaaacuaugacaagaaucggggcaaacgcaacaagcugcuccuggaagaugugcccgagaagaugaucgagagacagcuuaaugacacccgguacauuucuaaauuugucacacaucugcucuccaacaucgugcgcaaggacgaaguuaacagcaaagaugacggaauuaauucuaagaacaucaucccuggcaaugggaaaauuaccagccaacugaagcaggauuggggacugaacgacguguggaaugagcuuauccugcccagauucgaacggaugaacaaucucacaaacuccacggauuucaccagcacaaauaccaacggcaagauuaucccuacagucccccuggaguauucuaaaggguuuuccaagaaacgcauugaccacagacaccacgcgcucgaugcucuggugaucgcccuugccacccgggaccaugugaaucugcucaacaaugaaagcgcucugccgaagaaagauagaacgaaggaggagcagaaguccuuccgcuuugaccugcaggucaaccuucggaauaaagaaaaguacuucaacguuaaagagggaagagaaaaggagaaauuuaccacauucaagaaaccuuggaauacccugacacaagauacccgcgacgcccucgaaaacaugguggugucuuuuaagcagaaccugcgggucaucaauaaggcuacgaacuauuacgagagcuauacagacgagaauggcaaccucagacuggauaaauacgggaaucccaagaaagaacuuauuucccagaagggcaccaacugggccauccgcaaaucucugcacaaggagacagugagcggacagauucaccuggaccggguuaaggugaccaaaggcaagaucgucaccgcgacaagaaaaucccucgauucuagcuucaaugaaaaguccauugagagcaucacggacaccgggauucagaaaauccugcgcaacuaccuuaaggccaaggauaauaaaccugacguggcuuuuucucccgaaggaaucgaggagcugaacaaguccauuagcguuuauaaugaaggcaaaaaccaucaaccuaucauuaaggugcggaucuucgagcaggggucuaaauuucccgucggagaaacaggcaauaagauugccaaguucguggaggcugccaaagggaccaaccucuucuuuggcaucuaccaggauaagacaggaaaaagauccuaugacaccaucccgcugaaucucguuauugagcggcugaagcaaggccuuagcccugugcccgaaacgaacgagaaagggcaccagcugcuguuccaucucucucccaacgaucuggucuacgugccuacaaucgacgauaaugaacagcuugacuccaaccgcguguauaaguuuaccgauagcuccgacaccacauguaauuucauuccgagcaacaucucugcgauuaucuuuaauaucaacagcaaagagcaggaaaagagaggaauuaauuaccccauccaaaacgagcugggcgucggguccccucagucuaagaaucagaaauccuucgacggauuuaugauuaaggagguuugcaucaaacucaagguggaucggcugggcaacauuagcaaaaccuga

SEQ ID NO: 4551 - RNA, 4416 nt, Artificial Sequence
  Cas9 variant
augugcaaguacuucuauaucaaaaacuuuauuaccuucgugcugagcaaguccaucauucccaugaaacacauccucggccuggaccuugggucuaauagcauuggaugggccuuuguccagcaagauuucgagaacaagcagggcaaaaucaucgcuacaggguccagaauuaucccuauggaccagggcauucugggagauuuugaacgggggaauacgguuucucagaccgccgagcgcacaaccuacagaagcacacggcgccucagagaacggcaucugcuucgcagagagcggcugcaccgcgugcuccauauccugggauuccugccgccccacuaugacgcgcaaauugauuuuaccaagagauacggcaaguucaucgacaacgcugaaccuaaaauugccuauaauaacggcaauuuuaucuucaugaacuccuuuaaugagaugaucgaggauuucaagaaacaucagccccagcucuuuuacaagaaaucuaacggggaagagagcaagauuccuuaugacuggacaaucuacuaccugcggaagaaagcccuuucccagaagauuacccaacaggaacuggcuuggcucauccugcacuucaaucagaaacgcggauauuaccagcuuagaggcgaggaggaaacggagaaccccaauaaggaaguggccuuccacagccugaaagucguggauguugaggcugaagccccuaacaagaaaggggagauuugguauaccauccggcucgagaauggauggaucuaccgcagaacaucuaagauuccgcuggacgauuggaagggcaaaacccgggacuuuaucgugacaaccgaucugaacgacgacgggacgauuaaggucgauaaagaaggaaaggagaaaagauccuuccgcgcgcccgacgaaaacgauuggaaucuccugaagaagaaaacagagcaugacaucgauuuuagcggcaagaccgugggcgccuauauuuacgaccaccuucugcaaaacccuaaucagaaaaucaaggggaaacucguucggacaaucgaaagaaaguauuacaaggaugagcugaaagcuauucuugccaagcagaucgcucugcaacccgaacucuucaccgaaacccugcuggccgacuguauucgcgagcucuaccggaaaaacgaaacacagcagcagaaucugcuuucuaaggauuuucugcaucucuucguggaggacaucauuuucuaucaaagaccucugcgcuccaaaaagagcacgaucgcgaacugcacccuugaaaagcggucuuacauugauaaagagacaaaugagagaaaggacgcccccaucaaagucugugcuaaguccaacccguauuaccaggaauuucgcgugcugcaguggcuccagaaucugcggaucuaugagauugaaaccgacagagaggugacagccgaguuuaucgaaaccccucaagauugcgaggcucuguucaacuuucucaugagccagaaagaaauugacaauaagggacugcuuaaauacuuccuguuugccaagaacccccagaucaaggauaaagccgcuaaguccgagcucaaaaaguggcugacgacauaucgcuggaauuacgucuacgacgcggccgauaacucuagcaaaaaguauccuaugaaugaaaccggcuacgagcugcagcgguaucuucaaaagguugaggggcuccccgcuaacuuccugaccuucgacauuacauaccagcuguggcaccuccuguauuccgugaaagauaagguggaauuugagaaagcccuuaagaaauucgccaagaagaaacagcuggacaagaccagcuuugucgauucuuucaaaaacuuuaagcccuacccuaaugaauauggauccuucagcgagaaagcuaucaagaagcuccugccgcugaugagauuuggcaaccacugggacuucaaucggaucgaugugucuacacagaaacgcauugacgaucuuaucaacgggguugccaaugaagacauuagaacgaucauucgggagaaggcggagaaauaccaacucaacagcgaaaccuguuuucaggaccugccccuguggcucgcucaguacguggucuauaauagacaugccgaggccacagauaucgaaaaguggaccuccgugucugaccuggaggcuuaccuugaagauuucaaacaacacagccugcgcaacccuaucguugaacagguggucacagagacccuccggguggucagagacauuuggcagcaguauggaggcggccaagccaauuucuucgaugaaauccauauugagcuggggcgcgaacugaagaaaacggcugaggagagaaagcagcuuuccgacaagaaccaggaaaaugagagcaccaaccuccggaucaaaaagcugcuggccgaacucaaagaggaugcgucuauucagaaugugcgccccuacucccugguucaacaggaacuucugaagaucuaugaggagggaguguuuagcgccacagacgaagucgaggaagauauccagaaaauuagaaagaaggcugagccuucuaaagccgaccuccagcgguacaagcuguggcuggaacaaaaauauaagucccccuacaccggcgaggugaucagccuuacaaaacucuucaccgaggaauacgagauugaacacaucauuccgcagucccgcuauuacgaugacucucugagcaacaagguuaucugcgaguccgcugugaauaagcugaaaacgaaccagcucgggcuggaauuuauucaaaaccaucacggagagaaggucagaaucacagccaauaaagaggugaccaucuuuacagaggagcaguauaaggaguucgugaaaaagcacuacgcgaacaauucugccaagcagcagaaacuucugcucaacgagauuccugagaagaugguugcucggcaacugaaugauacccgcuauaucagcaaauacauuuccgaaauccugagcaagauugucagaucugacgagaaagacgaaggcgugaacuccaagaauaucauccccuguaccgggaagauuacaacggcccuuaaacaggauuggggccugaacgacguguggaauaagcucauccugccucgguuugagcgcaugaaccagcucacccagacacaacuguucaccagcuauaaugauagacuucagaaaaaccugcccacagucccuauugaauacucucagggauuucagaagaaacggaucgaccauagacaccaugcuauggaugcccucgugauugccugcgcuacccgcgagcacaucaauuacaugaacaaucaacacgcgcuggacaaguccaaagauaagaaggagaaacagcagagccggaucgaccugagaacgauucuuugugaaaagaaaaacaacaauuggcaguucaagaaacccuggucuacauuuacccaagaggccaaggaagcucuggagcauaucguugugagcuucaagcagaaccuccgcgucauuaauaaagccaccaacuauuacgaaaagugggaggagaaaaauggcgugcugguuaagaaaaaggugaagcaggaagggacaaacugggccauccggaaaccgcuccacaaggagaccgucuccggaaaaauugugcuggauagaaagaucggcaaagacaagauucuuacagcuacgcgcaaggccguugauaucaccuuuacagagaaaaucauuagcucuaucaccgacacagggauucaaaagauccugcucaauuaucugaaauacaagggauccccugaaguggcguucagcaccgaaggccuggaggagcuuaacaaaaauauugcucaguauaacaaugggaagaaacaucagcccaucuacaagguccggaucuuugaagagggcuccaaguucccccugggagaaacgggcgccaaagccaccaaguauguggaggcugccaaagggacaaaccucuucuuuggaguguaccagggcaaggggaaaagaaccuacgcgacaauuccucugaaugaggucaucgaacgccaaaagcagggacucccgucuguucccgagcggaacgaaaagggcgagccucugcuuuucagccugucccccaaugaccugguguaugugccuauggaaggggagauugcugagaccaucgauuuuaacaaucucucuaaagaacagaaggagagaauuuacaaaacagucagcuucaccggcaaccagugcuuuuucgugcaagaagccguugccacgcccaucgugaacaagauggaguauuccccucugaauaaaauggaacgggacauccuuggaacaaugauuaaggaggucuguaucaagcugaaaguggaucgccucggcaacauuaccaaggcuuga

SEQ ID NO: 4552 - RNA, 4416 nt, Artificial Sequence
  Cas9 variant
augggcuacaaggcccccagaaacgacaaaggggagaucgauuauggagugggccuggaccucgggaauggaagcgucggcuggguugcuauggauaaggacuaccaccugauucgggcccgcgggcaugaacuuaucggagcgagacuguucgauccugcuaacuccgccgagaaucggcgcgaaucuagaaccacacggcgcagacucagccggcgcagauggcggcugcgcaugcuugacucccuguuugccucugagcucgcuaaaauugauccgaacuuccuggccagacggaaguauagcugggugcaccccaaagacgaacagaaucaugagaacugguacggcuccaucauuuuuggcucuaaggagcaagauaagcaguucuauaaagacuacccuacgaucuaucaucugcgcaagaaacucaccgaagauacagagagacacgacauccgggaaauuuacguggcuauccaccacauugucaaguacagagggcauuuucugcgcgagggagagaucaauagcgaaaaccuuuucgaucccgagggcuuuguggaacugauuaaagacguuaucaagcucaauaacuccuaugacgagagcaccccuauuuucgaagccucucccgcggauguguccgaggcccugcuuaaugagcacacaagccggucugggagaaucgaagacacccuggauaagcucgacuuuuccgucagccgcguggauaaacaugagcugaagggaaugcgggacgcugccaaagcuguuaucggcgccauuguggggaacacagcggauuucucuaagaucuuuaaucuggacaaccucgauaaagacuccaaggauaaucugaaacuuaaguucgccgacagcaacuuugacgaaaaguacggaggcgucgugggcuccgggcugcucgaugagacccagauugaacugguggacagaauccacgcugucuaugaugccguugcucuuaaaggcauucugggagacgcccacacgaucucugaggccaagguggagagcuacgaaaaacaucgcaagaacuggaaacucaucaaggaggaacugcggaccaaggagaauaaagaugaaguggaccugugguauggggaucucuccggaagacaguacaagaacccuccggaccccgagaaaggcccugaugaggggagcaagaaagacucucccauucgcgauuccgaccaaaagcagaaucugaucaagaaagcuaacgauuauuucacagaacuuauugacgacagccagcugucugaggaacagaagaauugccucaaaaacgauaucaauaacggacaacuguucccuguccagcggagcuccgacaauggcgugauucccuaccagauccaccuuaacgagcugagacgcaucauugagaaucagaagcaauacuauccguuucucgcggaaaccuucauccggaaaacagccgagggcaagucuuacgaagagaacaagauuguugcucugcugaaauuuagagugccuuauuacgucgggccccucgugagcaaggaagauauggaggagcauuccagcggaaauucugccuaucacuggauggcccggaacccuggccgcggggaagcuaucacccccuggaauuucgacgagguuguggauaaagacgaauccggagccagauuuauuagccggcugacgggcacagauaccuaccuucugggggagcccacacucccucagcauucucugcuguaugaagaguacaugguccuuuccgagcucaacaacgugagacugaauguccgccagggcaaccacuggagcgacaagaaucggcaaagacuguccuacaaacagaaggaguuccucaucgaaaaccuguuuaaagaacacaagaccgugacccgcaagagagcggaggauugucuuucuagcaugggaugcggcgaaguucagcuguucgggcucuccgacgagaaaaaguuugcuucuagccuguccagcuauauuacacugaaaaagauccuuggaaaagccuucguggaugacucuggcaauuccgccauccucgagcggauuaucgaaguccagacgguguuugaggaucgcgaaccgcugacccaucaacugagccucauugacucucugacaguugagcagagaaagcagcuugcuaagauccacuacaccggguggggaaaacugucccggaagcuccugacaagcaaaaagggcucuuauaaaauucauagccagaacgagaucaugcgcacccaacacuccaucauugacaucaugagaggggauagccugaaucuuauugaaaucauucgggacaagaagaucggcaucggagaguggauugauaacgaaaaucucgaccgcgagacgggcgaaucugauguguccagacuggagagcgucuucgaggggaucgugaugucuccccgggugaaacgcggaguuguccaggccgugagagugauugacgaucuggcuaaggccaucggcaacccuccccagcggauuuuuaucgaaauggcggacgagguccaggccucccaaagaacagugagccgccucucccggcugaaagcucuuuacgggucuccuagccugcagaaggaguucaaugaucucaaagaccugagaaagucccugaacgaaaccaaggaugccgaccuucaggaagaccgccucuaucuguacuauauccagcugggaaaagaucucuacaccggcaaggagauuucuaucgacagccuguccagcgcuuacgauauugaccacaucguuccccaagcccuuacacaggaugacucuauugauaaucgggugcuggucuccagaaaagagaacgcgcgcaagaccgacagcuaucucuacacaccggaucugaucaaaaauaugcggccucugugggggaaacuucuggccgcuggccucaugucucagaaaaaguaugacgcccugacgagaguggaugacuucaaggaucgcgaaaaacaacgguuuguucagagaucccucguggagacccggcagauuaugaagaacgucagcacaauccugcgcaccuacuauggagaagacacaaacgugguuacccuuaaaucuuccaucacgcaugacaugagaaaguaccugggcuuccccuauaaaaaucgggauauuaacgacuaccaccaugcucaggaugcccucuguaucagcgccgcugggcaauuuaugcugaaucgccacuucguguccggaggcgaggucaccgacggggcgagcaacgccuacaauauguaucuggcugaauaccuucaggaguuuagagaugccaaggcccggggagagagaaagcgcucuacagcuuucggcuuugugguggggagcauguccucuaaagacgaugaaaagcggaccgaccauagaacaggcgagauugucuggagcgaaaccaacgccgaguaucugcgcaaaguuaugaauuacaagaaaaugcucaucacgcagaaggugggagaugugaagacacgggcgcuguaugacgagaccagauacggccacaaagaauccucugcuaagagcauuaaauucgauaaccuccgccgggacacaucccuguaugggggauuuucuggcgccagcaccgccuacaugaugcuugucgaguacaagaaaaagaauaagcugguguccaucaccgcucaggaagccagccuccuggcgguugcugaucaaaagaacgacacagugucugucauggacgggauccuggccucccacggacuuagcggcgccaagauucugcucccuaaaaucgugacgggccagcugcucgauuauucugacgcucugguuacccuucaguccgccagcgagcugaauacagcuagacagauguggcugccccgcaacgauuacaaugacauugauaucauucucaaguccaaagacaucgaagaugccgcgcauaagcugggguaugacucugauaccgugcacguccuuagacggauccaaaagcuguucgaggccguguuucgcguugcugagagccaguucccucuccaucagcuguccaaagaccaacaggaagagauucucagagauccccagaacuacggauuuggcagcgccgugaagcugcuugggggacugcugaaagcucuccacgccaaugccgaaaacacaaaccuggcuggccuugucaaggugcugcauggggacaaagaguauucugacgauggaaaggcgaaagaguucaagaaguucggcuuuuccccgcgguggcgcagaaucagcaauccuaccggcuucacgcucucugacagcgauacauuuauuuaccagucccccucugggaucuucgaacaacgggugaccgucaaagagcugaaggaaaaagccgacaagcagaaauga

SEQ ID NO: 4553 - RNA, 4422 nt, Artificial Sequence
  Cas9 variant
augaagaacauccugggccucgaccuggggaccaauagcauuggaugggcccuuaucgagaaagauacagaccagaagaacggcaauauucuggggacgggauccagaaucauucccaugucucaagauaucaaagacgaauuuggcaaggggaacagcaucucccagaccgcugaucggacaaaauuucgcucugugagacggcuccgcgagagacaucugcuucggcgcgaaagacugcaccggguccucaauguucugggauuccugccuaagcacuacgccgaccagauugauuuuaagaaacgccucggcaagcuggugaacgagaccgaaccgaaacuuguguaugacaauaagaacuucaucuuuaaaaagagcuucgaggcgaugcuguccgauuuuaaucagcaucaaccccuccugcuugcugacggcaagaaagucccuuucgauuggacaauuuacuaucugagaaagaaagcccucaccgagaagaucgaaaaagaggaacuggccuggcugauucucaacuuuaaucagaagcggggguacuaucagcugcgcggagaggaggaagaggaaaaccccaauaaaaugguggcuuuccacucucuuaagaucguugaggugauugccgacgaaagccagaagggcaaagcugagacaugguacucccugauccucgagaacggguggaucuauagacggagcucuaagaccccucuguacgauuggaaaggaaagcaacgcgacuuuauugucacgaccgaccuuaaugaugacggcuccaucaaaacagauaaggaagggcuggagaagcggagcuucagagcccccguggaagacgauuggacccucguuaaaaagaaaacagagcaggaaauuaacagaucucauaagaccgugggaacguacaucuaugagaaccugcugcaggacccuaaacagaagauuaagggcaaacucguccgcacaaucgagcgggaauuuuacaaggaugagcugaaaaugauccuuaagaaucaacagaaauuccacccggaacugaacgacgagcaccucuauauuaauugcgugagagaacuguaccgcaacaaucaggcgcaucaaaccauccuuuccaagaaggauuucgugcaccuguuuauugacgauaucauuuucuaucagcggccccucagaagccagaaaucuuccaucagcaacuguacacuggaguuucgcaaguacaaaaaugagaacggcaccgaccagaccgacuaucugaaggccaucccuaaaucccauccccucuuccaagaauuucggcuguggcaguggauuuacaaucuugggaucuaccagaaggaggaugacacaaacgucacggaugaacugauuaaaaauaucgacggauaucaggaucucuucgacuuucugaacaauaagaaggagauuagacaagauauccugauuaaauuccuuguugagcagaccggccucaaggggaaaccucugucuagcgugguggcuaaguaccgcuggaacuuugucgaagacaaaaucuaucccugcaaugagacaggaacccagauccggacaagacuggccaagguggaaaacaccccggaggauuuccucacggcugaaacagagauuaagcuguggcacaucauuuacuccguuaacgacaaagccgauuaugagaaggcgcuuaaaaccuuugccgaaaagcacaaucuggacacccauagcuucguggagaacuuuaaaaaguucccucccuucaagucugaauacggcuccuuuagcgagaaagcuaucaagaaacuccugccucugauucgccuugggaaguauuggucuugggaaaauaucgauaaaaagacacaggagcggaucgagaagauucucaccggagaguucgacgaagccaucaaaagcagaguccgggacaaggcuauucaccugacagaagaggaucauuuucaaggccugcagcucuggcuggccuccuacgugguuuacggccgccacucugaagccgacaaccuugauaaauggcauacgguggcugaccuggaggauuaucucgcggaguucagacagcacagccugcggaaucccaucgucgaacaggugauuaccgagacacugagagucgugaaggacaucuggcuucaauacgggcagggagccaaagauuucuucuccgaaauccacauugagcucgcucgcgagaugaagaacaccggcgacgaacggaaaagacugacaagccugguuaccgauaaugagaacacgaaucuccgcaucaaggugcugcuuucugaacugcucaacgacgggaaugucgagaacgugagacccuauuccccuaugcagcaagaagcccugaagauuuuugaggauggaguucugaauagcgacaucgagauugaagaugacauccuuaaaaucucuaagauggcccagccgaccaacacagagcucaaacgguacaagcuguggcuggaacagaaauaucgcucccccuacaccggccagauuaucccucucaauagacuguucacagcugacuaugagauugaacauaucauuccccaaagccgguuuuucgaugacuccuuuucuaacaagaucauuugugagagcgccgugaaccagcuuaaggauaaacagcuggggcucgaguucaucaagaaucacuccggcaccaucgucaaacugggaaugggcaagacggcgaaaauucuggacguggaaucuuacaacgaguuugugaaggggaauuacacaaagaacaucagcaaacgcaauaaacuuaugcuggaagagauuccugauaaaaugaucgaaagacagcucaacgacacccgguauauuuccaaguucaucaucagcgcucugucuaauauuguucgcuccgagagcaacgaugacggauucaauucuaaaaacguccuccccggcaaugggaagaucacauccagacugaagcaagauuggggaaugaacgacauuuggaaugagcuuauccugccgcgguuugaacgcaugaacaaaauuaccgauagcgccguguucaccgccuggaaugagaacaaccagaaguuucucccuaucgugccccuggaguucucuaaaggcuuucagaagaaaagaaucgaccaucggcaccacgcucuggacgcccuugucauugcugccagcacaagagaacauaucaaucugcucaacaaugagcacgcgaaguccgauaagcgcuucgaccugaaccggaaacucagaaaguuugaaaaaguggccuacaaugauccuaagacggggaaacgcauugagaaggaaguucccaccaucuuccugaaaccuugggagacauuuaccguggacgcuaagaacagccuugaaucuauuaucgucuccuucaagcagaaucugcgggugauuaacagagccacaaauuauagcgaguccuacaacgaugagaauggcgcucuccgccugggaaaagacggcaacccccugaaggaaaagaucaagcaaucuaaaggggauagcugggccauccggaagccgaugcauaaggacuuuguuuauggaaaagugcaccuucagaaugucaagcugccuaaagauaaguucauuaccgcgaucagaaaaucccucgacgugacguucgaucugaagcgcauugagacaaucaccgacaccggcauucagaagauccucaaaaacuaccugcauucuaaggaaaauaaaguugagcuugccuuuagccccgaagggaucgaggauaugaaccaacacauugagcgguauaaugacggaaagaaacaccagcccauccauaaggugagagucuucgaaauuggcucccgguuuucucugggggagagcggcaacaagaaaacaaaguucguggaagcugccaaaggaaccaaccuguuuuucgcuguguaccaggacgauaauaagggcaaacgcaacuacgagacaaucccucucaauauugucaucgaaagacagaagcuggggcuucacuccguuccgacggaggacgccaaaggaggcaagcugcucuuucaucugagccccaacgauaugguguaugugccuaccucugaggaacucgaggacaaucuggccuccgucaacaucaagcggcuuaauacagcucaacgcaaaagaauuuacaagguggaaaaagcgagcgggguugagugcuauuucauccggcaggauauugccuaccugaucaagaacuaugacgcuaaaaccaagauuggagagcuggaaucucagaauaagcuccagacaaccaugacggaugacagacugaaaaucaccgaugugugugucaaacuuaacauugaccgccugggcuccaucgccgagacauuucucgggaaucaauacggcgccagcaagaagaccuga

SEQ ID NO: 4554 - RNA, 4422 nt, Artificial Sequence
  Cas9 variant
auggccaagauccugggccucgaccuggggaccaacagcauuggaugggcuguggucgagagagaaaauaucgauuucucccuuauugacaaaggcguucggaucuuuucugagggggugaaaagcgaaaaaggaauugaguccucucgcgccgcggaaagaacaggcuaccggagcgcucgcaagaucaaauauagacggaagcugcgcaaguacgagacgcucaaagugcugucccuuaacagaaugugcccccugucuaucgaggaagucgaggaauggaagaaaagcggguucaaggauuauccucucaauccggaguuucugaaauggcuguccaccgacgaggaaagcaacgugaaucccuacuucuuucgggaucgcgccucuaagcacaagguuucccucuucgagcugggcagagccuuuuaucauauugcucagcggcgcggauuccuuagcaacagacuggaccaaucugccgaaggcauccucgaggaacacuguccuaaaauugaggcuaucguggaggaucugauuuccaucgacgaaauuagcacaaauaucaccgauuacuuuuucgagacagggauccuugacucuaacgaaaagaauggauaugccaaagaucuggacgagggcgauaagaaacucgucucccuguacaagagccugcucgcgauucugaaaaagaacgaauccgacuuugagaauugcaagucugagaucauugaacggcuuaacaaaaaggacgugcuggggaaaguuaagggaaaaaucaaggauauuagccaggccaugcucgacggcaauuacaagacccuggggcaguauuucuacucccuuuauagcaaagagaagauccgcaaccaguacacaucuagagaggaacauuaucuguccgaauuuaucaccauuuguaaagugcaaggaaucgaucagauuaaugaggaggaaaagaucaacgagaaaaaguucgacggccucgcuaaggaucuguacaaagccauuuucuuucagcggccccuuaagagccagaaaggccucaucgggaagugcucuuucgaaaagagcaaguccagaugugcuaucucucacccugacuuugaggaguaucgcauguggacguaccugaacaccauuaagaucggaacacaaagcgauaaaaagcugcgguuccugacccaggacgaaaaacucaagcugguccccaaauuuuacagaaagaaugauuucaacuuugacgugcuugccaaagagcugauugaaaagggcuccagcuucggguuuuauaagucuuccaaaaagaaugauuucuuuuacugguucaacuauaaaccuacagacaccguggcggccugccaggucgcugccagccucaagaaugcuaucggagaggacuggaaaacgaagucuuuuaaguaccagacaauuaacuccaauaaagaacaaguuagccgcaccguggauuauaaggaccuguggcaucugcucacaguggccaccuccgaugucuaccuguaugaguucgccaucgacaaacuuggccuggaugagaagaacgcuaaagcguucucuaagaccaagcucaaaaaggacuuugccagccugucccugucugcuauuaauaaaauccuuccguaccucaaggaagggcugcuguacagccacgccguguucguugccaacaucgagaauauuguggaugaaaacaucuggaaagacgagaagcagcgggauuauauuaagacacagaucuccgaaauuaucgagaauuacacgcucgagaaaagcagauuugaaaucauuaacggacugcuuaaggaguauaaaucugaaaaugaggacggcaagcgcgucuacuauuccaaagaagcugagcagagcuucgagaacgaucugaagaaaaagcucgugcuguuuuacaagucuaacgaaaucgagaauaaagaacaacaggagaccauuuucaacgagcugcuucccaucuuuauucagcaacucaaggacuaugaguucaucaaaauccagcggcuggaucagaagguucugauuuuucucaaaggcaagaaugaaacagggcagaucuucuguaccgaagagaagggaacagccgaagagaaagagaagaaaauuaagaacagacugaaaaagcuguaccacccuuccgacaucgaaaaguuuaaaaagaaaauuaucaaggacgaguucggcaaugagaaaaucgugcuugggagcccccucaccccuucuauuaagaaccccauggcgaugcgcgcucugcaucaacugcggaagguccuuaaugcccucauccuggaaggacagauugaugagaaaacgaucauucacaucgaaauggccagagagcugaacgacgcuaauaagcgcaaaggcauucaggauuaccagaacgacaauaagaaauuucgggaagaugccaucaaggagaucaagaaacucuauuucgaagacugcaagaaagagguggaaccgacagaggaugacauucugagauaccaacuuuggauggagcagaaccggagcgaaaucuaugaggaagggaagaauauuuccaucugugauauuaucggcagcaacccugcuuacgacaucgagcauaccauuccccgcucuagaucccaggauaauagccagaugaacaaaacccugugcucccaacgguucaacagagaggucaagaaacagucuaugccuaucgaacucaauaaccaccuggagauucugccccgcaucgcccacuggaaggaagaggcggacaaucuuacacgggaaauugagaucaucagcagauccauuaaggccgcugccaccaaagagaucaaggauaaaaagauucgcagacggcauuaucucacacugaaacgcgacuaccugcagggaaaguaugacagauuuaucugggaggaacccaaggugggcuucaaaaacucucaaauuccugauacggggaucauuaccaaguacgcucaggccuaccucaaaagcuauuuuaagaaaguugaauccgugaagggaggcauggucgcggaguuccggaagaucugggggauccaggaaucuuuuauugacgagaauggaaugaaacacuacaaggugaaagaucgcagcaagcauacacaccauaccaucgacgccauuacaaucgcuuguaugaccaaagagaaguaugauguucuggcccacgcuuggacgcuugaagaccagcaaaacaagaaagaggccagauccauuaucgaagccagcaagccguggaaaaccuucaaggaggaucugcucaaaaucgaagaggagauucuggugucucacuacacacccgacaaugucaagaaacaggcuaagaagaucgugcgggugcgcggcaaaaagcaguuuguugcggaagucgagagagaugugaacgggaaagccgugccuaagaaagcugccuccggcaagaccauuuauaagcuggacggagaaggcaaaaagcugccccggcuucagcaaggggauacaauccgcggaagccuccaucaggacucuauuuacggcgccaucaaaaauccucugaacaccgacgagaucaaguaugucauuagaaaagaucucgaguccaucaaggggagcgacguggaaucuauuguugaugagguggucaaggagaaaaucaaggaagcuauugccaauaaagugcugcuucuguccagcaacgcgcagcagaagaauaaacucguuggaacgguguggaugaacgaagagaagcggaucgcuauuaauaaggucagaaucuacgccaacuccgugaaaaacccccugcacaucaaggagcauagccugcuuucuaaaagcaagcacguucacaaacaaaagguguacggccagaaugacgaaaacuaugccauggcuauuuacgagcuggaugggaaacgcgacuucgaacucaucaauauuuuuaaccuggccaagcucaucaagcagggccaaggauucuauccgcugcauaaaaagaaagagauuaagggcaaaaucgucuuugugccuaucgaaaagcggaauaagagagaugugguccuuaaacgcgggcagcagguuguguucuacgacaaggagguggagaaccccaaagauauuuccgaaaucgucgacuucaagggacggauuuauaucauugagggccugucuauccagagaaucgugcgcccuagcgggaaaguugaugaauacggagugauuaugcuccgguauuuuaaggaggcgagaaaggcugacgauaucaaacaagacaauuucaagcccgacggcgucuuuaaacugggggaaaacaagccuacacgcaaaaugaaucacaaccaguucaccgccuuuguggagggcauugauuucaagguucugcccuccggaaaguuugagaaaaucuga

SEQ ID NO: 4555 - RNA, 4425 nt, Artificial Sequence
  Cas9 variant
augaagaaaauccugggccucgaccuggggaccaacagcauuggaugggcccuuaucgaguccgauuucgaaaagaaacagggcaagauuaaugggcugggaucuagaaucauucccaugagccaagacauccucggcaaauuugauuccggggugucuaucagccagacagcugagcggacguccuaccgcggagucagacggcugaaccagcgcaaucuucugagacgggaacgccuccacagaguucugaacauucuggacuuccucccuaagcauuauucuaaugccaucgauuuugagaagaaacugggccaguucaaggaaaacguggaggagaaacuuaauuacgcgaagaaccaaauuggccggcacgaauuuaucuucauggacagcuuuaaagagauggugaaggaguucaagcagacccagccgcagcuguuuuauaaacgcgaaaaugggauugagacaaagauccccuacgauuggacccucuauuaccugagaaagaaggcucuuucccaaaagauuaagaaagaggaacuggccuggaucauccucaacuucaaucagaagcggggauauuaccagcugcgcggcgaagacguccuggaugagagcaagauugaagacuuuuacucucucaaagugguugaggugcaggagacagaagauaagaacgccagagggaccugguauaaugucauccuggagaacgacuggguguacaaacggcaauccaaggaaagccuugauaauuggauugggaaaaacaaggaguucaucguuacaaccaacaaggaaaaagacggcucucugaagcucgacaaagcugggaaugugaagcgcaacuuuagagccgucgauuccgagaaagacuggauugcuaucaagaagaaaacggagcaggauguggaaaucagcaagcauaccgugggacaguauauuuacgagacacugcuucaaaaugccaaacagaagaucaaaggcaagcuggucaagaccauugaacggaaauucuauaaggaggaguucaucaaaauuaucaaggaacagcucaaacaccauccugagcugcagucuaagacacuguacgaaaccugcauccaagagcucuaucccagaaacgaagcgcaccagaauaacauuaaauccaagggcuuugaguaccuguucacggacgauaucauuuucuaccagcgcccucuuaagagcaaaaaguccacaaucucugggugucaguaugagacccggcuguucaaaaagacaguucucaauaaagugaccaacaaggaaaaugagauuuggcaaaaggaaccccugaaagccaucagcaagucccacccucuuuuucaggaguucagacuguggcaguuucucaaaaaccugaagauuuaccagaaagaagacgugaagggaaaucugaucgaucaugacaucaccagcgaucuccugaagacagaggcugacugggucgagcuuuucgauuuucugaacauuaaaaaggaaaucgagcaaaaacagauuauccaguucuuuauuaauaacaagcagaucgaaaaaggcaagaagaauaacuaucgcuggaacuacguggaggacaaaaaguauccgugcaaugaaacgaaaucucaacucaucucccggcugaagaaaguuaagaaccuggaccuuaaucucuucuuuaccagcgagacagagcugaaacuguggcacauuaucuacucugugaaggauaagauucaguaugaaaaagccaucaagaacuucgcuauuaaaaauaacaucgacaucgauagcuucgucgagaauuuuaagagauuucccccuuuuaaaaacgaauacgccgcguacuccgagaaggccauuaagcgccuccugccccuuaugcggaugggggaauauuggaaugagucugagaucaaacaggaagugaaggacagagcuuacagcauuaucgagcgccugaaaggaauugauuucaacaaggacaaaaucgaugaaaagaucaccgacgaugacauuaagaaacaacuccugaaguccuuuaucgauuucaaagacaagaauccucugaaaggccuuaacacauaucaggccuguuaccucguuuauaaucggcauagcgaggugaacucuauugcuuacuggaagucccccgaugacaucaauaaguaucuggagggguuuaaacagcacagccugagaaacccgauugucgaacagguggucaccgagacgcuccgcacagugcgggacaucuggcaauacuacggaaagggcaaagccucuuucuuuaacgaaauucacguugagcugggcagagaaaugaagaauccugccuauaaacggaaggcuuccaccaaccgcgugaccgagaaugagaacacaaaucauagaaucaaggaaauccuuaaagagcugcagaacgaagggguccaggagguuaagagcuacucccggaaucagcaagaaauucucaaaaucuaugaggagggaauuuaccagucuaucgaugugguggacgaugcgauugaaaagaucagaaagaacagcucccccaccaaggccgagaucauuaaauauaagcuguggcuggaacagggcuacacaucuccuuauacggggaagaccauccccaugagcaaacuuuucacaaccgacuaccagauugagcacaucauuccccaaucccucuacuuugauaauagccugucuaacaagaucaucugcgaauccgaggucaaucagcugaaagacaaccagacagcuuaugaguucauuaagaaacauggaaccgaaaaggugagccucggcaagaauaaaacgguggagaucuuuacccuggaacaauacgagaagcacuguaaccaguauuucaaaaagaauaaaaacaaacuuaagaaacugcucucugaggaaauuccugagggguucaucaaccgccagcugaaugauucccgguacauuagcaaguuuaucaaaggccugcuuggaaaccucguuagagaagaggacgaacaggaggucacaaccaagcauauugugccggugacaggcgccaucaccucuaaacugaagcaagauugggggcugaaugacaaguggaacgagcucgucgccagccgcuuccagagacugaauacgaugacaaacuccaauaacuuuggauauugggauaccaaaaucaaugcuuuccgggugcagguucccgacgaaauuagcaagggcuuuucuaaaaagcgcaucgaucacagacaccaugcccuugacgcgcuggugauugcuugcuguacacggaaccacaucaauuaccucaacgcccugaaugccgagaaaaagaacuaugggcugcgcgaccuucugcucauuaaaaaugauaagaaccauuacaccaaguucuuuaaacacccuugggacggauuccccgucgaagcuaaguccgugcuggagaaaaccaucaucagcuuuaagcagaauacaagaguuauuaacaaaacgaacaauaagaccuggcaaugggccgaaaaggagggccagcucaaaaaggugcuggucaaacagacaaagggggauaacugggcuauccggaaaccuaugcacaaggagaccguguccggcaaacuuaauauucccacaccgaaaggaaagaucgccaccgcgucucgcguuagccuguccgaaauuaaaacgagaaagcagcucgacaaaaucacagauaucucuauucaaaagauccuggagcggcaucugaacaauuaccuugacgauaagggcaaagaaaaguucgaccuggccuuuaacgcugaugggguggaggaacucaauaaaaacauuaagguccugaauaaaggaaagaaccaccagccuaucuauaaagugcgccucuacgagauuggcagcagauucaaggugggaaauuccggaaacaagaaagacaaguaugucgaggccgcuaaaggcaccaaucuguucuuugccaucuaccuuaacgaaaaggauaaaaagcggguuuaugagaccauuccccugaaugaagugaucgagcaucagaaacaggugucuaaccucccuaaaaacgagagaacacccgucccugugaaucacaccaaggggaaauuccuguuuagccugucccccaacgaccuuguuuacgugccgacagacgaagagaucgauaauccuagccuggucaacuucaauaaccucaauaagaaacaaguggaaaagauuuauaagacgguuucuugcuccaccuaccagugcuuuuucgugcauaacacaaucagcaaacccauucagaauaaggucgaguuuucugcgcugaacaaaauggaaaaguccaucgacggcauuaugaucaaagaucgcuguuggaagcucaagauggaccggcugggaaauaucauuagcgugaucagauga

SEQ ID NO: 4556 - RNA, 4443 nt, Artificial Sequence
  Cas9 variant
augaagaccauccugggccucgaccuggggacaaacagcauuggaugggccaaagugugcgucgauaaugacggcaacuaccuuagagauaucaagcuggggucccggauuauccccaugucucaggacacgcucggaaauuucgauaaaggcguuaccgacagcccuacagcugcccgcaccggguuuagaggagugcggcgcauuagagagcgggcgcugcaacgcagagaacggcuucaccgcgugcugcaugucaugaaguuccucccgccccacuaugagaacgcuaucggcuggaauagagaagaggccacaaccuacggcaaauuucugaaccauggggaaccuaagcuggccugggagaagcaggaggauggauccaugcgguuccucuuuauggacucuuuccacgaaaugauggcugauuuugccgagagccagcccggccugguggcugggggaaagaagaucccucuugacuggacacuguauuaccuccgcaaaaaggcccugacccaggcgauuagaaaagaagaacuugccuggauccugcucaauuucaaccaaaagcggggcuauuaccagcugcgcggggaggaagaugaggaaaaucccgcuaagagagaggaauaucaugagcugaaaguuguguccgucgaggccgcugaagagggaaagggcggcaacacgugguacaaugugacccucgaaaacggguggauuuaccggagacagucuaaaguugagcugcacgacugggugggaaagacacgccaguuuaucgucaccacagaauaugagaaagauggcgugaccauuaagaaagacaagaauggggaggugaagcggagcuucagagccccuuccgaagacgauuggggacuucgcaaaaagcggacggagagccugcucgaagacucuggcaaaacagucggggcguuuaucuacgaucacauucuguccgagccgaccgacaagaucagaggaaacuucauccgcacaauugaacggaaauauuacaagaaggagcuugaggccauccugcucgaacaaaccaaacaucacaaggagcugaaagaucagaauacccugauugcuuguaucaaggaacucuaucagagcaacaaaccccaucaggacucucugaugaagaaggauaugacauaccuucugauuacggaccucaucuuuuaucaaagaccucugaaauccaagaaaagccuuaucgccgauugccccuacgaguacuaugaguacaccauuaaggaaacaggcgagaucaaacgccagggcauuaaguguaucgcuaagucuaacccuuauuaccaggaguuccggcuguggcaauucauuaucaaucucagacuguuugaccgcaccgaugacaaagagguuacauccgaauaucugagcuccauggaggacuacaccaagcucuuuacguaucugaacgaucggaaagacaucaaucaggagacacuucugaaggauuucuucaaacagaagaaagugaagauggggauggaaaaggaguuucccauuagauggaacuacaucgaagacaaagagaagaaauacccgugcaaugaaacccggcacgagcuccuggccgcccuggauaaggcuggaauugaccacucuuggcuugaugacaaagagcgcuucuauagacucuggcaucugcuguacagcguggaauccaaggaggaagcggagggcgcccuccggaagcugaaagauaacgacgauuuugucaaugcuuuccuuaaggugaaaccuuuuaagaaagacuauggggccuacagcgaaaaggccguuaagaaacugcucgcuaucaugagaaugggaggccuguggaacgagaccgauauuugugagcagacacgcaaucggauccaaucuauuaucaagggggaaaucgacgagaaaauuaaggaaagaaugggccgcaccuucugccagcuguccgacuuucagggacuucccgaguggcucgccuguuauguggucuacggcagacacagcgaggcgacagauauccagcgguggacgaaaccugaaaaccugauggcuuauauuaauggguucaagcaacauucucugcgcaaccccaucguggagcagugcauucucgaaacccugagaacaguucacgacaucuggaaggaggccggacauaucgaugaaauucacguggagcuuggccggagcaugaaauccaccgccgaccagcgcgcuagaaugucuaagagcauccugcagaaugagaacacaaaucuccggauuaaaucccugcugauggaacuuaagaacgccaaagagaucgaaaacguccgccccuacagcccuaugcaacaggagauucucagaaucuacgaagagggggcucugcaggagcugaccaaggaagaugcccaguauccggagaucucuaaaauuucccaaauggcgcagcccagcgccaaggaacuccugaaguaccggcuuuggcuggagcagaaauauuguucuccuuacacgggaaagcccaucucccucagcaaacuguuuaccuccgcuuaucaaauugaacacaucauuccucagucucgcuacuucgacgauagcuucacaaauaaggugaucugcgagaccgaggucaaccagcugaaauccaauaugcuuggcuaugaauuuaucaagaagcauucuggggagauugugcacuguacaaccaucggcgacguuaaaauucucgaugccaaggaauacuacaacuucgugacggagcauuaugcuaauaacagacggaaaaaggagaaacugcugcucgaagacaucccccaggaguuucugaauagacaaaugaacgauagccgcuacauuuccaagaaggucauggccauccuuagcaauauugugcgggaagaggacgaacaggagacaaacucuaaauucguuguguccugcagcggaggcaucaccgauagacugaagcaggacugggggcucaaugacgucuggaacucuaucguguauccgcgcuuugagcggcugaauaaacugacacagaccgaagcguucggaagaugggagaacaaggaaggcaaacaaguguuucagaccucccuuccucuggagcuccagcgcggguucagcaagaagcggauugaucacagacaccaugccauggacgcucugguuaucgccugcgcuucucgcaauauuaucaacuaccucaacaaugaaagcgccaaaucccaggagcaacgggaggaucugagaaagaaacuuugugacaagaaccggauuauccgcaaacccugggaaacauuuacgcaggaugccagaaccgcucuggaggacgucguggugagcuucaagaauuauguccgggugaucaacaaggcgacaaauuacuaugaaaaauacgaugagucuggaaagaaaggcauggccgaacagaaggggcaagacaugugggcuauucgcaaaccuaugcacaaggagaccguuuuuggccaggugaaccucagacggaaagucacagugaagcugaaggaugcccuggagaauauccccgccauuugcgacaaagcucuuagagauuacguuaacgaccugaucgccaagaaauucaauaccaagcagaugcucgcgcauuuuaaauccauuaacuaucgccugaauaugaaaagcgugaacaaggucggaaucuggguguucuccgacgaaaaagagccuaugguugcuacgcggaaggccaucgauauuucuuucgacgccaaaagaaucgauacaauuaccgacaccggcauccagcaaauucucuguaaguaccugaaaagcaaggggaaugaucccaacguggcuuuuacaccggaaggaaucgccgagaugaauaagcacauuaucgacuauaacaacggcaaacagcaucagccuauccuuaagguccgcguguccgagcccaaaggggcgaaguaccaggugggagaaaccggcaauaaaacaaagaaguucgucgaggcucaaaaagggacgaaccuguauuuugccauuuacgaagauaaggacggcaaucggucuuauaacaccaucccccucaaugagguugccgaaagacugaaacagggacugagcccugugccggagaagaacgagaaaggcauuucccuuaaguucuaccugucucccaaugaucucguguacgucccuacagaagaggaaaaacugagcaacgagugcaagcucuccaaggaacgcaucuauaaaauggugagcucuaccuccaaugagugucacuuuauucccuacacaaccgcuaagccuaucuaugacaaauucgaguacgaagccaagaacaaaauggggcgggcucugacgggagagaugaucaaggccguuugcuggaaacuugaaguggauagacugggcaauauucugaagaucauuaaguga

SEQ ID NO: 4557 - RNA, 4452 nt, Artificial Sequence
  Cas9 variant
augaagaccauccugggccucgaccuggggacaaacagcauuggaugggccaaaaucuccauugaugacaauggcaacuaccuuagagauauccagauggggucucggauuauccccaugagccaagacgugcugggaaauuucgauuccggcgucacggagucucagaccgcuguucgcacaggguuuagaggacuccggcgcaucagagaacggagccugcuucgcagagagcggcugcaccgcgugcuccaugugaugggcuuccugccuccgcacuaugacuccgccauuggcuggaacaaggaagaacccaccacauacgggaaauuucugaaucauggagaaccuaagcucgcgugggagagacagggcgaugggucuaugcgguuccuguuuauggacagcuuccacaaaaugauggaggauuuugcuccccaucagccugcccuugucgccgacggacgcaagaucccccuggauuggacccucuauuaccugagaaagaaagcucuuacacaaccuauuaagaaagaggagcuggccuggauccuccugaacuucaaucagaagcggggcuauuaccagcugcgcggggaagaggaggaagagaacccgaccaaaagagaagaguaucacgaacucaaggugguuuccguggaggcugccgaggaaggaaagggcggcaauacgugguacaacgucaaacuggagaauggguggauuuaccggagaagcucuaagaucccccuugacgauugggugggaaaaacccgcccuuuuauuguuacaaccgaauaugaggcggacggcaucacacugaagaaaaacaaggaaggggaggugaaacgguccuucagagcccccggagaggacgauuggggccuccgcaagaagcggaccgaaagccagcuggaggcuucugggaaaacggucggagccuuuaucuacgaccaccuucuggcugaaccugccgauaagauuagaggcaauuucauccgcacaauugagcggaaauauuacaagcaagaacucgcggacauccugagagagcaguccaaauaucaugaggaacugcagagcaagaagauucucgccgauugcgcugaggaacuguaccgcucuaaccagccccaccgggacucccuucugaaaaaggauaugguguaucuccugcuuaccgacaucaucuuuuaccaaagaccgcugaaaagcaagaaaucccucauugccgauuguccuuacgaguauuacgaguauguggacaaggaaacaggcgagaucaagcgccaggggauuaaaugcgucgcuaagucuaaucccuacuaucaggaauuucggcuguggcaauucguucugaaccucagacuguacgaucggaccgaggacaaagaagugaccgccgaguaucuuccuagcaaggaggacuacgcccgccuguuuguguaccucaacgauagaaaagaaaucaaucaggagacacugcugaaggacuucuuuaagcucaaaaaggucaaacagcgguccgaaaaggaguuccccgugagauggaacuauauugaagauaaagagaagaaauaccccuguaaugagacgcgccaugaacuccugauggcucuggaccgggcgggaaucgagagaagcuggcucgaugacaccgcccgccagugcagacuguggcaccuucuguauucuaucgaaguuaaggaugaggcugaacgggcccuccgcaagcugaaagacgaugacgaguuuguguccgccuuccugaaggucaaaccuuuuaagaaagauuacggcgcuuauagcgagaaggccgugaagaaacuucucgcgguuaugagaauggggucucacuggugugaagacgauauuugcaaggagacaaaagaacggaucgagcauauucugcaaggagacguggaggaaaagaucaaagagcgcaugaaccacaccgcuuacagccugggcgaacucuccgacuuccaggcccugccggaguggcuugccuguuaugucguguacgggagacauucugaagcuacagauauuaagcacuggaagacccccgagagccugauggccuacaucaauggcuuuaaacagcauucccuccggaacccuauugucgagcagugcauccuggaaacgcugcgcacagugcacgacaucuggaaggaggcuggacacauugaugaaauccauguugagcuuggcagaagcaugaaaucuaccuccgaccaacgggcccgcaugaccgaaaauauucucagaaacgagaauacaaaccugcggaucaagagccugcucauggagcugaaaaaugaugcggacauuaaggaugugagacccuauucuccuaugcagcaggaaauccuucgcaucuacgaggaaggggcccugcaggagcucaccaaggaagacaacgauuaugaggagauuuucaaaaucuccaagaugccccaaccgagcgcuaaagaacugcugaaguacaaacuuuggcucgagcagaaguaucgguccccuuacacaggaaaacccauuucucugagcaagcuguuuacguccgccuaucagaucgaacacauuaucccucagucuagauacuucgacgauagcuuuaauaacaaggucaucugugaguccgaggugaaugcucucaaaggcaacaugcugggguacgaguucauuaagaaccauggaggcgaaaucguucacugcacccuucugggggacgugaaaguccaaaaugaaagcgaguauaaggccuucgugacagaacacuacgcgaacaauaaauauaagaaggagaaacuccugauggaggauauuccccaggacuuucugaaccgccaucuuaaugacucucgguacaucuccaaggugguuaaaacccugcucagcaacauugucagaacagaagaugagauggaaaccacgucuaaguucgugguguccuguaccggcggaaucacagaccgccugaaaaaggauuggggccucaaugacgucuggaacagcaucguguauucucgguuugagagacugaaugaacuuaccaagagcgaugccuucgggcgcugggagaacaaagagggaaagcggguuuuucagacauccgugccucuggaacuccaaagaggcuucaauaaaaagcggauugaccaccgccaucacgcuauggaugcccuggucaucgcuugcgccagcagaaacauuaucaauuaccugaacaaugagucugccaacucccccaaaaagcgggaagaccuucgccagcagcugugcgauaagaacagaauuauccggaaaccgugggagagcuuuacccaggacgcuagagcggcccucgaagaugugguuguguccuucaagaauuauguccgcgugauuaacaaagcuacgaauuacuacgagcgguaugacgccgacgggaagaaaacaaucaccaagcaaaagucuagagagaugugggccguucgcaaaccuaugcauaaggaaacaguguuuggacacgucaaccugcggagaaaagcuaucgugaagcucaaagaugcccuggagaauauucccagcaucuguaacaaggaacuucgcgacuacauuaauggccugguggagcggaacuucaauaccaaacagcuccacgcgcauuuuagauccaccgauuaucgcuggaacaagcagaaugucgacaagguugagguguggagauucucugaugaaaaagagccccugguggcuacacggaagccucuggacacgagcuuugaugccaaacgcaucgacaccauuacagauaccgggauccagaagauccuucugaacuaccucgaagccaaaggcggagacccgcugauugcuuucacacccgagggcaucgccgaaaugaaucaaaacauugcgcucuauaaugaugggaagaugcaccagccuauccugaaggucagaauuuccgagcccaaaggagcuaaguaccagaucggccagaccgggaacaaagccgacaaguucguggaggcccaaaaaggaacgaaccuuuauuuugcuaucuacgaagaugaggaccggaaucgcacauacaacaccauuccucugaaugaaguugccgagagacugaagcagggccuucccccugugcccgaaaagaacgagaaagaggucccgcugaaguucuaucuuucuccuaaugaccugguguacguucccaccgaagaggaaauccucaugaaagagugcaagcugaacaaaaaucggauuuauaagauggugagcuccacagggaaccaguguuucuucaucccuuuuagagucgcugugagcauuguuaauaagauggaauacucuccccucaacaaaauggagaaggccaucuccagcgagaugauuaaagcggugugcuggaagcuggaagucgaucgccuuggcaauaucauccggguggugaaauga

SEQ ID NO: 4558 - RNA, 4452 nt, Artificial Sequence
  Cas9 variant
augaagaccauccugggccucgaccuggggacaaacagcauuggaugggccaaagugucccuugaugacaauggcaacuaccugcacgauaucaagcucgggugcagaauuauccccaugucucaggacguccuggauaauuucggaaaaggcguuacggugagccaaaccuccgugcggacaggguuucgcggagucagacggauucgcgagagaucucuucagcggcgcgaaagacugcaucgggugcuccaccgccugggcuuccugccucagcauuaugacgcugccaucggcugggauagcgacugugcgaagaccuacgggaaauuucucgauaacggagagccgaagcuggcuugggaaagacaggaggacggcuccaugcgguuccuuuuuaugaauagcuucuaugaaaugaucgccgauuuuacaagccaccaacccgcccugguugcugacgggaagaaaauuccucucgauuggacccuguacuaucuucgcaagaaagcccugacacaggcuaucagaaaggaggagcucgccuggauucugcuguccuucaaccagaaacggggauacuaucagcuccgcggcgaagaggaagacgagaaucccaccaagagagaggaauuuugcgagcugaagguggucgcgguggaagccgcugagaaagggaagggagacgauaucugguacaacguucaucuugaaaauggcuguauuuaccggagaagcucuaaaaucucccuggacgauugggugggcaagacgaaacaauucauuaucaccacagaguaugagaaggacggggucaccccuaaaaaggauaaggacggaaaagaaaagcgcagcuaccgggcccccaaagaggaugacuggggccucagaaagaaacgcacagaaaccgaucuggaggcuucugggaagacggugggagccuuuaucuaugaacaccuucuggcggagccuuucgacaagauucggggcaacuuuauccacacaauugagagaaaauacuaucgcgccgaacucgaggcuauccugaccgaacagcggaaguaccaugaggaacugagauccgagcagaugcucgccgugugcgcugaggaacuguaucgcagcaaucuuccgcaccagcaaucucugcucaaaaaggauauggucuaccugcuucuguccgaccucauuuucuaccagcggccccugaaaagcaagaagucccugaucgccgacuguccuuaugaguacuauagauacguugauaaagaaacaggggagaucaagaaacagggaauuaagugcaucgccaaaucuaaccccuauuaccaagaguuccgccucuggcaguuugugcugaaucuucggcuguucgacagaaugaccgauaaggaagugaccgcugacuaucucccuacaaaggaggauuacguccggcuguuugacuaccugaacaaucgcaaagaaauuaaccaggagacgcuucucaaggauuucuuuagacugaaaaaggugaaacugggccgggaaaaggaguucgagaucagauggaacuauauugaagacaaagagaagaaguaccccuguaaugaaacccgcuaugagcuccugguugcgcuugaucgggccggcaucgacagaagcuggaucgaugaagacgggcgccaguacagacuguggcaucuccuguauuccauugaggugaaagcugaggccgaaagcgcccugcggaaacuuaacucugaugacgcuuuugucuccagcuuccucaaagugaagccguuuaaaaaggacuacggagccuauucugagaaggcgguuaaaaagcugcuggcugugaugcgcaugggcagcaugugguccgaagccaauaucugcgaggaaacacaaaaccggauuagaucuaucauucgcggggauaucgaggagaaaauuaaggaaagaaugggacacaccgcccggagcuucaaucagaucgacgauuuucaggcucucccugaguggcuggccuguuacgucguguacggccgccacuccgaagucacagacauccagcauugggagacccccgagcaacuucagagcuauauuaacggguucaaacagcacucucugagaaauccuaucguggaacagugcauucucgagacgcugcggacaguucaugauaucuggaaggaagcuggccacauugacgagauccauguggaacugggacgcgauaugaagagaaccgccgaccaacgggcgagaaugaccaaaaacauccuuaagaaugagaacacaaaucuccgcauuaaaucccugcugauggagcucaagaaagauaccgacaucaaggaaguccggcccuacagccccaugcagcaggagauucugagaaucuaugaagagggcgcccuucugcagcucaagcgcgaugacgaggcuuuugccgauauuucuaaaaucucccaaauggcucagccuacagccacggaacugcggagauacaagcuguggcuugaccagaaauaucgcagcccguacaccgggaaguucaucucccucucuaaacuguucacaagcgcguaucaaauugagcacgugaucccccagucccgguacuuugacgauucuuucagcaacaagguuauuugugaagccgaggugaauagacugaaauccaacaugcucggauacgaauuuaucaaggcucacggcggggagauuguccauugcaccaugcugggagacgugaagauccuuagcgaaucugaguauaaagccuucgugaaugagcacuacguuaaccaucgcgcuaagaaagaaaagcugcucauggaggauaucccucaggaauuucugaaccggcagaugaaugacuccagauauauuagcaaagucgugaaggcccugcuuucuaacaucgugcggacagaggaugagauggacgucaccuccaaguucgugguucccugcagcggcgggauuacggaucgccugaaaaaggacuggggccucaaugauguguggaacucuaucgucuacccuagauuugaacggcugaaucgcaugaccggaacagaggccuucggccacugggaaaacaaagaggggaagagaguguuucaaaccagcguucccauugaacuccagcugggauucuccaaaaagcggaucgaccacagacaucacgcuauggaugcgcuugugauugccugugcuagccgcaauaucaucaacuaucugaauaacgagucugccaauucccagaagaaacgggaggaccucagacgccugcugugcgacaagaaccggauuaucagaaaaccgugggaaucuuuuacacaggaugcccgcgucgcccuucaagacauugugguuuccuucaagaauuacgugcggaucauuaacaaagcuaccaauuauuacgagagauacgaugaacagggcaagaagacgacagcggagcagaaaucuagcgaaaugugggcuauccgcaagccuaugcauaaagagaccgucuuugggcacgugaaccugaagagaaaaacaaccgugaagcucaagaacgccaucgagaauauucccaacaucuguaauaaagaacugaaggccuauauuaacgagcucgucgaaaaacauuucaauaccaagcagaugcuggcucacuucaaauccaucaacuaccgguggaaucgccaaaacguugagaagguggaaguguggcaguauucugacgagaaagagagaauggccgcgacacggaagccucuugauacgagcuuugacaagaaacgcauugaaaccaucacagauaccggaauccagaagauucugcucaauuaccuggaggaaaaaggcggggaccccaacaucgcuuucacaccugagggcauugccgagaugaauaagaacaucucccuguuuaaugauggaaaacuucaccaacccauucugaaggucagaguggccaagaccaugggcgcuaaauaucagguugggcagacgggaaacaaggccgcuaaauacgugggcgcccaggaagggacaaaucucuauuucgcgaucuacgagaacgaagagggagaacggucuuacaacgccgucccgcugaaugagguggcugagagacucaagcaaggcaugagcccuguucccgaaaagaacgagaaggacgugccccugaaguuuuaucuuuccccuaaugaucuggucuacgugccgaccgaagaggacaaacugagcaacgaaugcaagcucgauaaugagcgcauuuauaaaaugguuucugccaccgggaagaaaugucauuuccugcccuacuccguggcuaacaucaucuauaauaaggucgaguuugaaagcaugaacaagaugggcaaagcccuuucuggagagaugauuaaggccgugugcuggaaacuggaaguggaccggcucggcacaauccugagagucauuaaguga

SEQ ID NO: 4559 - RNA, 4452 nt, Artificial Sequence
  Cas9 variant
augaagaccgagcuggaccucaacaaagauagacuguacaagcacgugcuuggccuggaccucggggucacaagcaucggauucgcccauguuguggaauccgagaaucggaacgaaucugagauuaaacagaucggcgugcgcgucauucaacuggauaauuuugacaagguggauaaaagcgggaagacguccgaaucuaagaaccccgcuguugacuucgccgcgggaaaaggccuuaccccuaaugggagcagaacaaagaaacggggagcucgcagaaaccuggaucgguaucaggaccgcagagauaaucuccuggaggugcugaccaaguccggcuuuaucaacucugagacaaaacggaccgaagacggcaagcacacaacccaucagacgugggagauucgcgccaaggccgucagcgaaaaaguggagaaggaggaauuugcuagaauccuccuggccaucaauaaaaagcggggguacaaauccagccgcaaggcuaaaaacgaggaugaaggacaggccguugacggcauggcgguggccaagagacuuuaugaggaaaaucugaccccggggcaauacgcuuaugagguccucucuggaggcaagaaauccauucccgauuuuuaccggagcgaccugcaggccgaguucgacaagaucuggaacuuucagaaacaguucuauccuaauauucuuacagaugaauuuuacgaggaacugaaggggaaaggacaacgcgcuaccucugccgcguucuggaagauccaccaguuuaacacagccgacauuaaggaucucgaggacgaacugaaaaaugagagaaccaucaagcuguccaaacgggaucagaagaaacuccaggcuuacaaguggagaagcgaggccguggugaagcaacugggcaaagaagaggucgcuuauguucuuacggaaauuaacaacaaucugaacaauucuuccggcuaccucggggccaucagcgaccgcuccaaggagcuguauuucaacaaacagacagugggacaguuucuuuacaagcaacugaaagaaaauccccauacccggcucaagaaccagguguucuauagacaggauuaccuggacgaguucgagacaaucugggaaaugcaggcccaauuucacccugagcugacccaggaacucaaggaggagauucgcgauaucauuaucuucuaucagcggaaacugaagucucagaaaggccuuauuagcuuuugcgaacuggaguccaaggaagucgugaucaaugacaccaaaaagaucauugggcucagaguugcucccaaaagcucuccucuguuccaagaguuuaagaucuggcagaaccuuaauaacgugcugguccgcaagaaaggaucccggaagagaauggugaaagcgcagaaucagcacagccucuucgaggaaccgaaggagauuuucucucuggaucuggccagcaaagaaaaacucuucgaggaacugaaccuuaagggcaaucuguccgcuaaaaacugucucgacauccuggggcuuaauucuaacgagugggaacugaacuacacacaacucgagggaaaucgcacgaacaagagccuguacgaggccuuucugaaaauucucgacaucgaaggcuaugauguuaaggaccugcuuaaagugaaguccagcaaggaugaggucgaacuggacgaucucaaagugcccgccucugagaucaagaauaugguccgggaaauuuucuccaccaacaaaaucgacacagagauucuggauuuugacgcugagaucgauggcaaggccuucgaaaaacagagcucuuaccagcuguggcaucuucucuauuccuacgagggggacgauagccaguccggaaaugaaaagcuguaugagcugcucgcgaagaaauuuggcuucaagagagagcacgcucaaauucuggccaacgugucucuuguugacgauuacgggaaucugagcuccaaagccaugcgcaagaucuauccucauauucgggaaaacaauuacucuaccgcuugcgagcucgugggauacagacacagcaaacacucccugacaaaggacgaacugaaagaccggguccuugaggaucgccucgaacugcugaagaagaacagccucagacagcccgugguugagaaaauccugaaucagaugaucaacgccgugaaugcucuuauugagaagaacucugaacgggacgagaauggcaacaucaccaaauauuucaaguuugaugaaauuagaaucgagcuggcccgcgaacucaaaaagaacgcggccgagcgggcugagaugacgacaaauauuaacgccgcuaagcugguccaugaaaagaucuucaagauccugcaaaaugaguuugggauuaaaaacccuaccagaaaugacaucauucgcuacagacuuuaugaggaacucaagggcaacggauacaaagaucuguauuccaauaccuacaucccccgggaaauucuguucagcaaccagaucgacaucgaucacauucucccgcagucucgccuguuugacgauuccuucagcaauaagguggugguuuuuagaaaggacaaccuuaaaaagggcaaucagacagccaucgauuauauugggucugaggucggagaggaaggccugaaaaacuucaucgagcggguggaaagccucuacgagcuggggaagaaaaauaaggaggaaggaauuuccaaggcgaaauaccaaaagcugcuuaaaagcgccucugagaucggcgacggguuuaucgaacgcgaucugagagagucccaguauauugcuaagaaagccaaggaacuccuguucaaggugacccggagcgucguguccacaucuggcagcaucacggaccgccucagagaggacuggggacugauuaacguuaugaaagagcuuaaucugccuaaguacaaaucccucggccugaccgaaauccaggagcggcgcaacgggcaucagguggaagucauuaaggauuggacaaaaagaaacgaccaccggcaucacgcuauggaugcccuggccguggcuuuuaccaagcacaaucauauccaauaucuuaacuaccugaaugcgcgcaaaaacgagucucacaagcuccauggaaauauuaucgccaucgaaacacuggagaccgagguuaagauugacgaucucggcaacaaaaagagaguguucaaagaacccaucccuaauuuucggcaggucgcuaaggagcaccuggaaaacgugcuuauuagccacaaagccaagaauaagguugugacgaaaaacaagaauaaaaucuccgggaaggagaaacugcagauuacccucacacccagaggacagcugcauaaggaaaccgucuauggcaaguaccgcuucuaucaaucuaaagacgagaaggugagcgccaaauucgaucuggagacaaucgaaaagguggcuaaccccuccuacaaagccgcgcuucugcagcggcucaaugagaacgaaaaugacccuaagaaggcuuuuagcgggaaaaacgcccugucuaagaauccgaucuacauuuccauggagaacgauaucaaaguccccgacaccguuaagcucguguggcuggaggaagauuauagcauuagaaaagacgugacgccugagaacuucaaggacgaaaaaucuaucgagaagauucuugaugaaggcgucaagcgcauccugaaaaaucggcugaaggaguuuggaggcgacgccaaagaggcuuucuccgaucucgacaagaaccccaucuggcugaaugaagagaaagggacaagcauuaagagagugcgcaucucuggaguuaagaacgccgaaccucuucacuacaaaaaggaucauuuuggcaaugacauucuggaugggaacggaaauaaaauccccgcggacuucguguccaccggcaacaaucaccaugucgcuauuuauaaggagccggaauuugauaaaaaggggcagccugugcucgacgagcugggcaaccaaaaguacaaucuccaggagaaaguugugagcuucuuugaagccgucgagcgggugaaccagggacugcccaucauugauaagacauauaaucagcaccuuggcuggcaauucuuuuucaccaugaaacagaacgaaauguucguuuuuccuaaugagaagaccagauucaaccccaucgaaaucgaccugcuggauccuaacaauaaaaagcucauuucccugaaccuuuuucgggugcagaagaucgccaauaaaaacuacauguuccgccaccaucuggagacaaaugucgacgacaagaaagagaugaagaacauugcuuuuauccacauucagagcuguaaucuccugaaagaaaucaucaaggugagacucaaccaucugggggauauugugucugucggagaguauuga

SEQ ID NO: 4560 - RNA, 4452 nt, Artificial Sequence
  Cas9 variant
augaagaccauccugggccucgaccuggggacaaacagcauuggaugggccaaaguguccgucgaugaccacggcaauuaccuucaugauaucaagcuggggucuagaauuauccccaugagccaggacauucucggaaacuucgauaaaggcguuacggagucccaaaccgcuauccggacaggguuucgcucugugagacggauccgcgaaagaagccugcuucggcgcgagagacugcaccgggugcuccaugucaugggauuccugccuccgcacuaugacuccgccauuggcuggaaucgcgaagaggcgucuaccuacggcaaguuucugaaccauggggaacccaaacucgcuugggagagacuggaggauggaagcaugcgguuccuuuuuauggacuccuuccacgaaaugauggccaauuuugcccgccaccagccugcucugguggccgauggcagaaagaucccccucgacuggacacuguauuaccuucggaagaaagcucugagccaggccguugggaaggaggaacucgcguggauucugcugaacuucaaucagaaacgcggauauugccaacucagaggcgaggaggaagaggaaaccccuacaaagcgggaggaauacuaugagcugaaaguggucucuguggaggccgcugaagaggggaagggaggcaacaccugguacagaguucagcuugaaaauggcuggaucuaccgccggcccuccaagauugcccuggaugacuggguggggaaaacgaagcaguuuaucgucaccacagaguaugaaaaagauggaaccacacucaagaaagacaaggacggcgaggugaaacgcagcuucagagcuccuggggagaacgauuggggacugcggaagaagagaaccgaaucucagcuugaggccuccggcaaaacggugggggcguuuauuuacgaccaucugcucgccgaaccggcugauaagauccgcggaaauuucauccggacaauugagagaaaauauuacaagcaagaacuggaggccauccugcgcgagcagaccaaacaccaugaggaacuccggagcaaggaaaugcuggcuaagugugccgaggagcuuuaucagucuaaccagccccacagaaaaucccugcucaauaaggacaugacauaccugcuucugaccgaucucauuuucuaucaacgcccucugaaaagcaagaaaucccugaucgccgaaugccccuacgaguacuauaaguacaaggacaaagaaaagggcaaaaagaaacggcagggcauuaagugugucgcuaagucuaacccuuauuaccaggaguucagacucuggcaauucaucguuaaucugcggcuuuuugaucgcaccgacgauaaagaagugacagcggaguaucugagaagccgggaggacuacgccagacucuucgcuuaucugaacgaucgcaaggaaaucaaccaggagacgcugcuuaaagacuuuuucgggcucaagaaagugaagauuggagccgaaaaagaguuugccauccgguggaauuacauugaagacaaggagaagaaauaccccugcaacgagaccagacacgaacugcugcucgcucuggaucgcgccggcauggacagauccuggcuugaugacagcgagcugcaguaucggcucuggcaucugcuguacucugucgaagcgcgcgaugaggcugaaggggcccuuagaaagcuccgggacgaugacgaguucgugggagccuuucugaaaguuaagccguucaaaaaggauuauggcgcuuacuccgagaaggccgugaaaaagcugcucgcugucaugcgcauggggagcugguggcacgaagaggacaucuguaaacagacaagagaucggauugaacgcaucgugcaaggcgacaucgaggagaagauuagagaacggaugggacaugccgcguauucuuuuagccgccuggccgauuuccagggccuuccugaguggcuggcuugcuacguuguguaugggagacacuccgaagccacccauauccuccggugggacucucccgacaaacugcugagcuacauuaagggauuuagacagcacucccuucgcaauccuaucgucgagcaguguauucucgaaacacugcggaccgugcacgauaucuggaaggaggcuggccauauugacgagauccacgucgaacuggggagaagcaugaaaucuacggccgagcaacgcgcgcauaugacaaagaacauccuccggaaugaaaacaccaaucugagaauuaaaugccuucugauggagcucaagaacgaugccgacgugaaagauguucgccccuacucccccaugcagcaggaaauccugcggauuuaugaggagggagcucugcagcaacuuaccaaggacgaugccgaauacgcugagaucagcaagauuucuaaaauggcccagccuuccgccaaggaacuccugagauauaaacuguggcucgagcagaaguaccgcagcccguauacaggcaaacccaucucccugucuaaacuuuucaccagcgcuuaccagaucgaacacgugauuccucaaucccgguauuuugacgauucuuucaauaacaaggucaucugugagagcgaggugaauacacugaaguccaacaugcucggguacgaauuuauuaagaaucacugcggcgagaucguucauuguacgaugcugggagacgugaaagucuuuagcgaaucugaguacaaggcguucgugaccgagcacuauuccaacaauaaauacaagaaagaaaagcugcuucuggaggauauuccccaggaauuucucaacagacagaugaacgacagccgguauaucucuaaggugguuaaaggccugcucuccaaugucgugcgcacagaggaugaacuggaggccaccagcaaguucguggucucuugcacagggggaaucaccgacagacuuaaaaaggacuggggccugaacgauguguggaauagcauuguuuacucccgguuugagcgccucaacgggcugacgaaaagcgaacauuucggacacugggagaauaaggaaggcaagagaguguuucaaaccucugucccuauggagcugcagcggggguucaacaaaaagagaaucgaccaucgccaccacgcuauggaugcccuugugauugccugcgcuucccggaauaucauuaacuaucugaauaacgaauuugccaaaagccccaagcagagagaggaccuccgccagcugcucugugauaaaaaucggaucaucagaaagccgugggagacauucacccaagacgcgcgcgcugcccuggaagauguuguggucuccuuuaagaacuacgugcggguuauuaauaaaacaaccaacuauuacgagagauacgacgccgauggcaagaaaacgauggugccucagaagggaaaugaaaugugggcuguccgcaaacccaugcaugagggcacaauguaugggagagugaaccuucggcgcaaggccguggucaagcugaaagaagcgcucgagaacaucucuagcauuugcaauaaggagcugagagacuacaucaacguucugguggaaaaacaguucaauaccaagcagcuucuggcucacuuuaaauccauggauuaucgguggaacaagcaacauauugacaaaguggaggucuggcgcuucucugacgaaaaggugcagaugguugccgccagaaagccucucgauaccagcuucgacaaagaguguaucgcuuccauuacagauaccggaauccagaagauccugcucaauuaccuggagucuaaaggcggggaccccgccauugcuuuuacaagcgaaggaaucgccgagaugaaccagaauauugcgguguauaacgauggcaagaaacaccaaccugucaucaaggugcggaaguccacgaaacuugggaagaaauucgccguuggccagauuggaugcaagagcaaacaguuuguggucgcugaagccggcaccaaucuguacuucgcuaucuaugaggacgaagaggggaagagaucuuacgauacaaucccccugaacgaggugaccgaacgccucaagcaaggacuguccccgguuccugagaaaaaugaaaaggaggugccccuuaaauuuuaccugagccccaacgaccucgucuaugugccuacagaagaugagaugcagaugaaggaguguaaacugaauaaggaacggauuuacaagauggugucuuccaccggcaacgagugccauuuccucccguauagcgucgccucuguuaucuacaauaaaguggaauuugaguccaugaacaagauggggagagcccugacgggagaaaugauuaaagcuguguguuggaaacuugacgucgaucgccugggcaacauccugcgggugauuaaguga

SEQ ID NO: 4561 - RNA, 4452 nt, Artificial Sequence
  Cas9 variant
augaagaccauccugggccucgaccuggggacaaacagcauuggaugggccaaaaucuccauugaugacaauggcaacuaccuuagagauauccagcuggggucucggauuauccccaugagccaagacgugcucggaaauuucgauaacggcgucacggagucccagaccgcuguucgcacaggguuuagaggacugcggcgcaucagagaacggucucuucugcgcagagagcggcuccaccgcgugcugcaugugaugggcuuccugccuccgcacuaugacagcgccauuggcuggaauaaggaagaacccaccacauacgggaaauuucucaaccauggagaaccuaagcuggcgugggagagacagggcgauggguccaugcgguuccuuuuuauggacucuuuccacaaaaugauggaggauuuugcuccccaucagccugcccuggucgccgacggacgcaagaucccccucgauuggacccuguauuaccuuagaaagaaagcucugacacaaccuauuaagaaagaggagcucgccuggauccugcugaauuucaaccagaagcggggcuauuaccagcuccgcggggaagaggaggaagagaauccgaccaaaagagaagaguaucacgaacugaaggugguuggaguggaggcugccgaggaaggcaagggcgggaacacgugguacaaugucaaacuugagaacggauggauuuaccggagaagcuccaagaucccccuggacgauugggugggcaaaacccgcccuuuuauuguuacaaccgaauaugaggcggacgggaucacacucaagaaaaauaaggaaggagaggugaaacggagcuucagagcccccggcgaggacgauugggggcuguggaagaagcgcaccgaaucucagcuugaggcuuccggaaaaacggucggcgccuuuaucuacgaccaccuucucgcugaaccugccgauaagauucggggcaacuucaucagaacaauugagcgcaaauauuacaagcaagaacuggcggacauccugcgggagcagagcaaauaucaugaggaacuccagucuaagaagauucuggccgauugcgcugaggaacuuuacagauccaaucagccccaccgcgacagccugcucaaaaaggauaugguguaucugcuucugaccgaccucaucuuuuaccaacggccgcugaaaucuaagaaaucccugaucgccgauuguccuuacgaguauuacgaguauguggacaaggaaacaggggagauuaagagacagggaaucaaaugcauugcuaagagcaaccccuacuaucaggaguuccgccucuggcaauucguccugaaccuucggcuguacgauagaaccgaagacaaagaaguuaccgccgaguaucucccuuccaaggaggacuacgcccggcuguuuguguaccugaaugaucgcaaagaaaucaaccaggagacacuucucaaggacuucuuuaagcugaaaaaggugaaacagagaucugaaaaggauuuccccguccgguggaauuauauugaggacaaagaaaagaaauaccccuguaacgagacgagacaugagcugcucauggcucuggaucgcgcgggcaucgaacggagcuggcuugacgauaccgccagacaguaucgccuguggcaccuccuguacuccaucgaggugaaggacgaagcugagagagcccugcggaagcugaaagaugacgaugaauuuguuagcgccuuccucaaggugaaaccuuuuaagaaagacuauggggcuuacucugagaaggccgucaagaaacugcuggcggugaugcgcaugggaucccacuggugcgaggaugacauuuguaaggaaacaaaagagagaaucgaacauauucuccaaggcgacguuggggagaagaucaaagagcggaugaaucacaccgcuuauagccugggcgaacuuucugauuuccaggcccugccggaguggcucgccugcuacguggucuacggacgccauagcgaagcuacagacauuaagcacuggaagacccccgagucccugauggccuauaucaacggcuuuaaacagcauucucugagaaauccuauuguggaacaguguauccuugagacgcuccggacaguccacgauaucuggaaggaggcugggcacauugacgaaauccauguggagcugggacgcagcaugaaauccaccagcgaucaaagagcccggaugaccgaaaacauucugcgcaaugagaacacaaaucucagaaucaagucucugcuuauggaacugaaaaacgacgcggauauuaaggacguucggcccuacuccccuaugcagcaggagauccucagaaucuaugaggaaggcgcccugcaggagcugaccaaggaagauaaugacuacgaggaaauuuucaaaaucagcaagaugccccaaccgucugcuaaagagcuucucaaguauaaacuguggcuggagcagaaguaccgcuccccuuauacagggaaacccauuagccucuccaagcuguuuacgucugccuaccagaucgaacacauuaucccucagagccgguacuucgaugacuccuuuaacaauaaggugaucugcgagucugaagucaacgcucuuaaaggaaacaugcugggcuaugaguucauuaagaaucaugggggcgagaucgugcacuguacccuccugggagauguuaaagugcaaaacgaaagcgaguacaaggccuucgucacagaacacuaugcgaauaacaaauacaagaaggagaaacugcuuauggaagacauuccccaggacuuucugaauagacaucucaacgauucccgcuauaucagcaagguggugaaaacccugcucucuaauauuguucggacagaggacgagauggaaaccacguccaaguucgucgugagcugcaccggcgggaucacagauagacugaaaaaggacuggggacuuaacgauguguggaacucuaucgucuacucccgcuuugagcggcugaaugaacucaccaagagcgacgccuucggcagaugggagaauaaagaagggaagcgcguguuucagacaucuguuccucuggagcugcaacggggauucaacaaaaagagaauugaucaccggcaucacgcuauggacgcccuugugaucgcuugugccagccgcaauauuaucaacuaucugaauaacgaguccgccaacagccccaaaaagagagaagaucuccggcagcagcugugcgacaagaaucgcauuaucagaaaaccgugggagucuuuuacccaggaugcucgggcggcccucgaagacgucgugguuuccuucaagaacuacgugagagucauuaauaaagcuacgaacuacuaugagcgcuacgacgccgauggcaagaaaacaaucaccaagcaaaagagccgggaaaugugggccgugagaaaaccuaugcauaaggagacaguuuuugggcacgugaaucugcgccggaaagcuaucgucaaacuuaaggacgcccuggagaacauucccuccaucugcaauaaggaacucagagauuauauuaacggccugguggagcgcaauuucaacaccaaacagcugcacgcgcauuuucggucuaccgacuacagauggaauaagcagaacguggauaaggucgaaguuuggcgcuucagcgacgagaaagagccccuuguggcuacaagaaagccucuggauacguccuuugacgccaaacggaucgauaccauuacagacaccggaauccagaagauccuccugaauuaucucgaagccaaaggcggggauccgcugauugcuuucacacccgagggaaucgccgaaaugaaccaaaauauugcgcuuuacaacgacggcaagaugcaccagccuauccugaaggugcgcauuucugagcccaaaggggcuaaguaucagaucggacagaccggcaacaaagccgauaaguucgucgaagcccaaaaagggacgaaucuguacuuugcuaucuacgaggacgaggacagaaaccggacauauaauaccauuccucucaacgaaguggccgagcgccugaagcagggccuucccccuguucccgaaaagaaugagaaagaagugccgcugaaguucuaccucagcccuaacgaucuggucuaugugcccaccgaggaggaaauccucaugaaagaguguaagcugaauaaaaacagaauuuacaagaugguuuccucuacaggaaaucagugcuuuuucaucccuuuucggguggcugucagcauugugaacaagauggaauauagcccccuuaauaaaauggagaaggccaucuccucugaaaugauuaaagcgguuuguuggaagcuggagguggacagacugggcaacaucauccgcgucgugaaauga

SEQ ID NO: 4562 - RNA, 4458 nt, Artificial Sequence
  Cas9 variant
augaagaacauccugggccucgaccuggggaccaauagcauuggaugggccaaaaucuccauugaugacaacggcaaguacaucaaagauucuauuaaacuugggagcagaaucauccccaugucccaggacgugcugucuaauuucagcaaaggagucacacucucccaaacgucugagcggaccagcuuucgcggcgcuagacggcugcgcgaaagaacacuucugcggcgcgagagacuccaccggauucugcaucugcucggguuccugccuaagcacuaugaaaaggccaucggaugggaucgcaacgacaauaaaaccuacggcaaguuuauuaaccaugcggagccgaaacuugcuuggugcaaggauaauaacggcaaaaugagauuccuguuuauggacuccuuccacgauaugcucagcgaauuuucugagaagcaucccgagcugcuugccaaugggaagaaaaucccucuggacuggacaauuuauuaccuccggaagaaagcccuguauaaggcuaucaccaaagaagaacuggccuggauucuccugaacuucaaucagaagcgcggauacuaucagcuuagaggcgaagaggaucgggacuccgaggcuaacaaaaaggaauaccuggagcucaagguuaucgggguggaagccacaggagagaaaaagggcaaugauaucugguacaacauucaccuggaaaauggguggaucuaucgcagaagcucuaaaaacccccuuaacgacuggcugggaaaggugaaauccuuuauugucaccacggaccucgaugcggacggcaauccuaagaaggauaaagacggcaacaucaagcggagcuucagagcccccucugagggggauuggacccugauuaaaaagcgcacagagucccugcucgaaaauagcggacagaccgugggccaauuuaucuacaaccacauccuggaggaaccuuccgcuaaaauucgggggaauuucaucagaacaauugagcgcaaguauuacaaggacgaacuuaaagccauccuggagaagcagaaagaguuucaucacgaacucucuagcgagucccugcuuaccgaaugugcuaaggagcuguauaaacggaacauugcccaucaggaaguucuccugaagaagggaaugauccaccuucuccugaaugauauccuuuucuaccagagaccgcugaaaauuaagaaaagccucaucgacaacugccccuaugagaauuacaaguacguggauaaaaagucuggcgacauuaaagucaaguccaucaaguguauugcgaaaagcaacccuuucuuucaagaguuccgccuguggcaguuugugucuaaucugcggcuuuauagaaagagcgaugacaaagacguuacguccgaacaccucgugacaaccgaugacuacgccaaccuguucacauaucugaauaaccgcaaggauaucaaacagucuguccuccugaaggaguacuuuaagauuaaaaaggugaaaaccaucaauggggcugaauaucccgugcgguggaacuacaucgacgaugacaacaagaccuauccuugcaaugagacaagauacgauauucuucaugcccugagcaaaacggagcucaaguccgaauggcugacccccgagcgcacauaccggcuguggcaccuucucuauagcaucgaaucuaaggaggaaaccaaaaaggcucugaacaaacugaaucucuccgacgauuucacagaggccuuucugaccauuaagccguucaaaaaggaguacggaagcuauucugaaaaggccaucaaaaagcugcugucccucaugagaaugggcuaccuguggagcgaggacgaagcuauuaaacaggucggcgcggagaucgaaaagacgaucgagggggagcugccugauuauguucuucaacggcucgaaaaaucccagcauaacuacaauaagauuucugacuuuagcggacugccccuguggcucgccuccuauaucauuuacggccgccacucugaggcuaaagaaaucauucauugggauaacccugagagcaugauggccuacaucaaggacuucagacagcacuccaugcggaaucccaucguggaacaaugugugcuggagacacuuagaaccguccacgacauuuggaaggagaucgggcauauugaugaaauccacauugagcugggacgcgaaaugaaaagcaccucugagcagcggaaggccaucacacagaacgugcuccauaaucagaacaccaauaucagaauuaaacugcugcuucaagagcucaagaacgacaauaacaucacaggcguucgccccuauuccccuaugcagcaggaaauucugagaaucuacgaggaaggggcucugcagggccucacgaaagaggauaaggacuauaaugauauucugaagaucagccaaaccgcccagccgacaucuaacgaacuuacccgguacaaacuguggcucgagcagaaguaucgcucccccuacacaggaaaagcgauuagccugucuaagcuguuuaccagcgcuuaucagaucgagcacgugaucccucaauccagauacuucgacgauagccuuucuaacaaagucauuugcgaauccgaggugaauacgcugaagaaggccaugcucggcauggaauuuaucaaaaccugugggggacagaagguucacugcacacugcucggcgacguggagauuuacaacgaagaggauuauaaagccuucgucaaugagcauuacagcaacaaucggaccaagcgcaacaaacugcuuauggaagacaucccccaggaguucauuaauagacagcugaacgauucccgguauaucucuaagauggugaagcaacuccugagcgcuaucguccgcgggcaggaagagguggaagccacauccaaauuuguuauuccuuguaccggaggcaucacggacagacugaagaaagauugggggcuuaaugacauuuggaacaaucuggugucuccccgguuccagcgcaugaacgcucucacaggcagcgaguacuuuggacacugggagaauaaggaaggcaaaagagucuuccaaaccacaaugccgauccagcugcagcagggguuuuccaagaagcggauugaccauagacaccaugccauggaugcgcucgugaucgccugcgcuucucgcaacaucauuagcuaucugaauaacgagaccgcccaagacaccgaacggagacgcgaucuucggcagaaacugugugacaagggaggcuccguuagaaaaccuugggauagcuucacacaggacacgcaguacgcucucaaggauaucauugugaccuuuaaaaacuauguccgcaucauuaauaaggccacaaacuacuacgagcacuauaaaaccgacgggaagaagggaaugaucucucaaaaaggcgaugagcugugggcgauucggaagcccaugcacaaagaaacaguguucgggaaggugaaucugagacgcccuaaacggguuucccuuagcaaggccaucgacucugucgaugugaucugcaacagaaagcugaaaaaguacauuaaagcucggcucaaugagggccugcagaagaaacagauccucaacauuuuuaaggaagugaauaacgucugggagggaaucgacgugaauaagauugacaucugggaaauguccaacgauaaagagcccaugguugccacccgcaagcagcuggacacgagcuucgaugagaaaaagaucagaucuauuuccgacacaggcauccaaaagauucuucugaauuaucugaucaccaagaacaauaacccugaacucgcuuuuacccccgaggggauucaggaaaugaauagcaacaucuccgaguacaaugaucauaagaaacaccagccgaucuauaaggugcgggucacagaaccucugggagccaaauaccccauuggcaccauggggaacaaccccaagaaauucguggaggcccaagcuggaacaaaucuuuauuuugcgaucuacgaggacaaggaaggcaaccgcaauuacgauacgauuccucugaacaucgccgcugagagacucaaucagcagcugagcccgguucccgaaaccaacgagaauaacacaccucucaaauucuaucugucucccaaugaccuuguguacgucccuagcgaagaggagcggcauuccgggaacaauauucagcuggauaagaacagaaucuauaagauggugucuagcaccuccaaacaaugcuucuuuauucaccaucgcguugccaucucucugguggacaagaaagaguucagcgcccagaauaagauggagcgguccaucgauaacgaacaggucaugauuaaaucuguguguuggaagcucaucacagacagacugggcaauauuaucaaggugauuaaauga

SEQ ID NO: 4563 - RNA, 4458 nt, Artificial Sequence
  Cas9 variant
augaagaacauccugggccucgaccuggggaccaauagcauuggaugggccaaaaucuccauugaugacaacggcaaguacaucaaagauucuauuaaacuugggagcagaaucauccccaugucccaggacgugcugucuaauuucagcaaaggagucacacucucccaaacgucugagcggaccagcuuucgcggcgcuagacggcugcgcgaaagaacacuucugcggcgcgagagacuccaccggauucugcaucugcucggguuccugccuaagcacuaugaaaaggccaucggaugggaucgcaacgacaauaaaaccuacggcaaguuuauuaaccaugcggagccgaaacuugcuuggugcaaggauaauaacggcaaaaugagauuccuguuuauggacuccuuccacgauaugcucagcgaauuuucugagaagcaucccgagcugcuugccaaugggaagaaaaucccucuggacuggacaauuuauuaccuccggaagaaagcccuguauaaggcuaucaccaaagaagaacuggccuggauucuccugaacuucaaucagaagcgcggauacuaucagcuuagaggcgaagaggaucgggacuccgaggcuaacaaaaaggaauaccuggagcucaagguuaucgggguggaagccacaggagagaaaaagggcaaugauaucugguacaacauucaccuggaaaauggguggaucuaucgcagaagcucuaaaaacccccuuaacgacuggcugggaaaggugaaauccuuuauugucaccacggaccucgaugcggacggcaauccuaagaaggauaaagacggcaacaucaagcggagcuucagagcccccucugagggggauuggacccugauuaaaaagcgcacagagucccugcucgaaaauagcggacagaccgugggccaauuuaucuacaaccacauccuggaggaaccuuccgcuaaaauucgggggaauuucaucagaacaauugagcgcaaguauuacaaggacgaacuuaaagccauccuggagaagcagaaagaguuucaucacgaacucucuagcgagucccugcuuaccgaaugugcuaaggagcuguauaaacggaacauugcccaucaggaaguucuccugaagaagggaaucauccaccuucuccugaaugauauucuuuucuaccagagaccgcugaaaaucaagaaaagccucauugacaacugccccuaugagaauuacaaguacguggauaaaaagucuggcgacaucaaagucaaguccauuaaguguaucgcgaaaagcaacccuuucuuucaagaguuccgccuguggcaguuugugucuaaucugcggcuuuauagaaagagcgaugacaaagacguuacguccgaacaccucgugacaaccgaugacuacgccaaccuguucacauaucugaauaaccgcaaggauauuaaacagucuguccuccugaaggaguacuuuaagaucaaaaaggugaaaaccaucaauggggcugaauaucccgugcgguggaacuacauugacgaugacaacaagaccuauccuugcaaugagacaagauacgauauccuucaugcccugagcaaaacggagcucaaguccgaauggcugacccccgagcgcacauaccggcuguggcaccuucucuauagcauugaaucuaaggaggaaaccaaaaaggcucugaacaaacugaaucucuccgacgauuucacagaggccuuucugaccaucaagccguucaaaaaggaguacggaagcuauucugaaaaggccauuaaaaagcugcugucccucaugagaaugggcuaccuguggagcgaggacgaagcuaucaaacaggucggcgcggagaucgaaaagacgauugagggggagcugccugauuauguucuucaacggcucgaaaaaucccagcauaacuacaauaagaucucugacuuuagcggacugccccuguggcucgccuccuauauuaucuacggccgccacucugaggcuaaagaaauuauccauugggauaacccugagagcaugauggccuacaucaaggacuucagacagcacuccaugcggaaucccauuguggaacaaugugugcuggagacacuuagaaccguccacgacaucuggaaggagauugggcauaucgaugaaauucacaucgagcugggacgcgaaaugaaaagcaccucugagcagcggaaggccaucacacagaacgugcuccauaaucagaacaccaauauuagaaucaaacugcugcuucaagagcucaagaacgacaauaacauuacaggcguucgccccuauuccccuaugcagcaggaaauccugagaauuuacgaggaaggggcucugcagggccucacgaaagaggauaaggacuauaaugauauccugaagauuagccaaaccgcccagccgacaucuaacgaacuuacccgguacaaacuguggcucgagcagaaguaucgcucccccuacacaggaaaagcgaucagccugucuaagcuguuuaccagcgcuuaucagaucgagcacgugauuccucaauccagauacuucgacgauagccuuucuaacaaagucaucugcgaauccgaggugaauacgcugaagaaggccaugcucggcauggaauuuauuaaaaccugugggggacagaagguucacugcacacugcucggcgacguggagaucuacaacgaagaggauuauaaagccuucgucaaugagcauuacagcaacaaucggaccaagcgcaacaaacugcuuauggaagacauuccccaggaguucaucaauagacagcugaacgauucccgguauaucucuaagauggugaagcaacuccugagcgcuauuguccgcgggcaggaagagguggaagccacauccaaauuuguuaucccuuguaccggaggcauuacggacagacugaagaaagauugggggcuuaaugacaucuggaacaaucuggugucuccccgguuccagcgcaugaacgcucucacaggcagcgaguacuuuggacacugggagaauaaggaaggcaaaagagucuuccaaaccacaaugccgauucagcugcagcagggguuuuccaagaagcggaucgaccauagacaccaugccauggaugcgcucgugaucgccugcgcuucucgcaacauuaucagcuaucugaauaacgagaccgcccaagacaccgaacggagacgcgaucuucggcagaaacugugugacaagggaggcuccguuagaaaaccuugggauagcuucacacaggacacgcaguacgcucucaaggauauuaucgugaccuuuaaaaacuauguccgcauuaucaauaaggccacaaacuacuacgagcacuauaaaaccgacgggaagaagggaaugauuucucaaaaaggcgaugagcugugggcgauccggaagcccaugcacaaagaaacaguguucgggaaggugaaucugagacgcccuaaacggguuucccuuagcaaggccaucgacucugucgauauuaucugcaacagaaagcugaaaaaguacauuaaagcucggcucaaugagggccugcagaagaaacagauccucaacauuuuuaaggaacugaauaacgugugggagggaaucgacgugaauaagaucgacauuugggaaauguccaacgauaaagagcccauggucgccacccgcaagcagcuugacacgagcuucgaugagaaaaagaucagaucuauuuccgacacaggcauccaaaagauucugcugaauuaucucaucaccaagaacaauaacccugaacuggcuuuuacccccgaggggauccaggaaaugaauagcaacauuuccgaguacaaugaucauaagaaacaccagccgaucuauaaggugcggguuacagaaccucuuggagccaaauaccccauuggcaccauggggaacaaccccaagaaauucguggaggcccaagcuggaacaaaucuguauuuugcgaucuacgaggacaaggaaggcaaacgcaacuacgauacgauuccucucaauaucgccgcugagagacugaaccagcagcucagcccgguccccgaaaccaaugagaacaauacaccucugaaguucuaucuuucucccaacgaccugguguacguuccuagcgaagaggagcggcauuccgggaauaacauucagcuggauaagaauagaaucuauaaaauggugucuagcaccuccaagcgcugcuucuuuauccaccaucgggucgccauuucucucguggacaaaaaggaguucagcgcccaaaacaaaauggagagauccaucgauaaugaacagguuaugauuaagucuguguguuggaagcugaucacagaccgccuuggcaacauuaucaaagucaucaaguga

SEQ ID NO: 4564 - RNA, 4458 nt, Artificial Sequence
  Cas9 variant
augaagaacauccugggccucgaccuggggaccaauagcauuggaugggccaaaaucuccauugaugacaacggcaaguacaucaaagauucuauuaaacuugggagcagaaucauccccaugucccaggacgugcugucuaauuucagcaaaggagucacacucucccaaacgucugagcggaccagcuuucgcggcgcuagacggcugcgcgaaagaacacuucugcggcgcgagagacuccaccggauucugcaucugcucggguuccugccuaagcacuaugaaaaggccaucggaugggaucgcaacgacaauaaaaccuacggcaaguuuauuaaccaugcggagccgaaacuugcuuggugcaaggauaauaacggcaaaaugagauuccuguuuauggacuccuuccacgauaugcucagcgaauuuucugagaagcaucccgagcugcuugccaaugggaagaaaaucccucuggacuggacaauuuauuaccuccggaagaaagcccuguauaaggcuaucaccaaagaggagcuggccuggauucuccugaacuucaaucagaagcgcggauacuaucagcuuagaggcgaagaggaucgggacuccgaggcuaacaaaaaggaauaccuggagcucaagguuaucgggguggaagccacaggagagaaaaagggcaaugauaucugguacaacauucaccuggaaaauggguggaucuaucgcagaagcucuaaaaacccccuuaacgacuggcugggaaaggugaaauccuuuauugucaccacggaccucgaugcggacggcaauccuaagaaggauaaagacggcaacaucaagcggagcuucagagcccccucugagggggauuggacccugauuaaaaagcgcacagagucccugcucgaaaauagcggacagaccgugggccaauuuaucuacaaccacauccuggaggaaccuuccgcuaaaauucgggggaauuucaucagaacaauugagcgcaaguauuacaaggacgaacuuaaagccauccuggagaagcagaaagaguuucaucacgaacucucuagcgagucccugcuuaccgaaugugcuaaggagcuguauaaacggaacauugcccaucaggaaguucuccugaagaagggaaugauccaccuucuccugaaugauauccuuuucuaccagagaccgcugaaaauuaagaaaagccucaucgacaacugccccuaugagaauuacaaguacguggauaaaaagucuggcgacauuaaagucaaguccaucaaguguauugcgaaaagcaacccuuucuuucaagaguuccgccuguggcaguuugugucuaaucugcggcuuuauagaaagagcgaugacaaagacguuacguccgaacaccucgugacaaccgaugacuacgccaaccuguucacauaucugaauaaccgcaaggauaucaaacagucuguccuccugaaggaguacuuuaagauuaaaaaggugaaaaccaucaauggggcugaauaucccgugcgguggaacuacaucgacgaugacaacaagaccuauccuugcaaugagacaagauacgauauucuucaugcccugagcaaaacggagcucaaguccgaauggcugacccccgagcgcacauaccggcuguggcaccuucucuauagcaucgaaucuaaggaggaaaccaaaaaggcucugaacaaacugaaucucuccgacgauuucacagaggccuuucugaccauuaagccguucaaaaaggaguacggaagcuauucugaaaaggccaucaaaaagcugcugucccucaugagaaugggcuaccuguggagcgaggacgaagcuauuaaacaggucggcgcggagaucgaaaagacgaucgagggggagcugccugauuauguucuucaacggcucgaaaaaucccagcauaacuacaauaagauuucugacuuuagcggacugccccuguggcucgccuccuauaucauuuacggccgccacucugaggcuaaagaaaucauucauugggauaacccugagagcaugauggccuacaucaaggacuucagacagcacuccaugcggaaucccaucguggaacaaugugugcuggagacacuuagaaccguccacgacauuuggaaggagaucgggcauauugaugaaauccacauugagcugggacgcgaaaugaaaagcaccucugagcagcggaaggccaucacacagaacgugcuccauaaucagaacaccaauaucagaauuaaacugcugcuucaagagcucaagaacgacaauaacaucacaggcguucgccccuauuccccuaugcagcaggaaauucugagaaucuacgaggaaggggcucugcagggccucacgaaagaggauaaggacuauaaugauauucugaagaucagccaaaccgcccagccgacaucuaacgaacuuacccgguacaaacuguggcucgagcagaaguaucgcucccccuacacaggaaaagcgauuagccugucuaagcuguuuaccagcgcuuaucagaucgagcacgugaucccucaauccagauacuucgacgauagccuuucuaacaaagucauuugcgaauccgaggugaauacgcugaagaaggccaugcucggcauggaauuuaucaaaaccugugggggacagaagguucacugcacacugcucggcgacguggagauuuacaacgaagaggauuauaaagccuucgucaaugagcauuacagcaacaaucggaccaagcgcaacaaacugcuuauggaagacaucccccaggaguucauuaauagacagcugaacgauucccgguauaucucuaagauggugaagcaacuccugagcgcuaucguccgcgggcaggaagagguggaagccacauccaaauuuguuauuccuuguaccggaggcaucacggacagacugaagaaagauugggggcuuaaugacauuuggaacaaucuggugucuccccgguuccagcgcaugaacgcucucacaggcagcgaguacuuuggacacugggagaauaaggaaggcaaaagagucuuccaaaccacaaugccgauccagcugcagcagggguuuuccaagaagcggauugaccauagacaccaugccauggaugcgcucgugaucgccugcgcuucucgcaacaucauuagcuaucugaauaacgagaccgcccaagacaccgaacggagacgcgaucuucggcagaaacugugugacaagggaggcuccguuagaaaaccuugggauagcuucacacaggacacgcaguacgcucucaaggauaucauugugaccuuuaaaaacuauguccgcaucauuaauaaggccacaaacuacuacgagcacuauaaaaccgacgggaagaagggaaugaucucucaaaaaggcgaugagcugugggcgauucggaagcccaugcacaaagaaacaguguucgggaaggugaaucugagacgcccuaaacggguuucccuuagcaaggccaucgacucugucgaugugaucugcaacagaaagcugaaaaaguacauuaaagcucggcucaaugagggccugcagaagaaacagauccucaacauuuuuaaggaacugaauaacgugugggagggaaucgacgucaauaagauugacaucugggaaauguccaacgauaaagagcccaugguggccacccgcaagcagcuugacacgagcuucgaugagaaaaagaucagaucuauuuccgacacaggcauccaaaagauucugcugaauuaucucaucaccaagaacaauaacccugaacuggcuuuuacccccgaggggauucaggaaaugaauagcaacaucuccgaguacaaugaucauaaggaacaccagccgaucuauaaaguucgggugacagagccucuuggagccaaguaccccauuggcaccauggggaacaaacccaagaaauucgucgaggcccaagcuggaacaaaccuguauuuugcgaucuacgaagacaaggagggcaaucgcaacuacgauacgauuccucucaauaucgccgcugaaagacugaaccagcagcucagcccggugcccgagaccaaugaaaacaauacaccucugaaauucuaucuuucucccaacgaccugguuuacgugccuagcgaggaggaacggcauuccgggaauaacauucagcuggauaagaauagaaucuauaagauggucucuagcaccuccaaacaaugcuucuuuauucaccaucgcguggccaucucucucguugacaagaaagaguucagcgcccagaacaagauggaacgguccaucgauaaugaacaggugaugauuaaaucugucuguuggaagcugaucacagacagacuuggcaacauuaucaaggugauuaaauga

SEQ ID NO: 4565 - RNA, 4461 nt, Artificial Sequence
  Cas9 variant
augaccaagauccugggccucgaccuggggacaaacagcauuggaugggccaucagagaggaugaaaaugagggcgugaaccagauuaucgacaaagggguccggauuuucuccgaaggaguuaagucugagaauggcaaagaaaucagccgcgcugccgagagaacggcguaccgguccgcucgcaagaucaaauauagacggaaacuucgcaaguacgagacccugaaagugcucucugugaacgggaugugcccccugagcgucgaagagguggaacaauggaagaaauccggauuuaaggaguauccucuuaauccggaguuccugaacuggcucagaacaaaugaagauaaaaacauuaaucccuacuuuuuccgggacaaggccucuaagcagaaaguuacccuguuugagcugggccgcgcccucuaucacaucgcucagagacggggcuuccugagcaaccgccuugaucaguccgccgaagggguguuugaggaacauaauccucaaauucagaaccugaucgaggaccucgauagcucuaauacaauucugaacgagcuuaaggaauacuauaucaaucugggaauuaucgacgaguccgaaaagagcggcuucaagaaagaucucgacgagggggaaaagaaccugaaaaagcuguacaccucucucgucuccaucacaaagaaaaacgcuaaugauauugagaccuguaagcaggagcugaucgccagacuuaacaaaaaggaagaccugggaaaagugaagggcgagauuaaggauaucagccaggcgaugcucgacgggaauuuuaaaacgcugggacaauacuucuuuucucuuuauaacaagacccggauucgcaaucaguacacauccagagaggagcacuaucuggaagaguucaucaucauuugccagacccagggcaucgaggaaauuaacacaaaugagaaacuccccgaaaagaaauuuaccggccuggccaaggaccuguaccgggcuaucuucuuccaaagaccucucaagagccagaaagggcugauuggaaaguguuccuuugagaaaaacaagucucgcugcgccguuagccaucccgauuaugaggaguuccggaugugguccuaccuuaauacgaucaaaaucggcacacagagcgaaaagacccugagauuucucacacuggaagagaaacuuaagcuggugccuaaguucuaucgcaaaaacgacuuuaauuucgaaguccucgcuaaggagcugguggagaaaggggccucuuuuggauacuacaaguccagcaaaaagaacgaguucuuuuauugguucaauuacaagccgaccgauucugugagcgcgugugucguuuccgccucucuggaaaacgcuauuggcaaagacuggaagaccaaaacauuugaauaucaaacgagcaauaccaagaaagaggaagugacaaaguccgugaacuacaaggaucucuggcaucugcuuagcgucgccaccucugacacauaucuguacgauuucgcuaucgagaaacucaagcuggagcccaaaaacgccaaggccuuuuccaaaaccaagcugaagaaagacuucgcuagccuuucucucgcggccauugcuaagauccugccuuaucugaaacaggggcuccuguacucccacgccguguucauugccaauaucgaaaacauuguugaugcugacaucuggaaggauaaagagcagcagaaguuuauccaaagcaagauuguggaccuuaucgacaauuaccuggucgaaaaauccaagcucgagauuaucaacugccugcugaaaauuuauaauacggaagauaucgagggacggaagguguacuauucuaaagaggccgaaagccuuuucgaggcggaccucagaaagaaacugguucccuuuuacaaggcuaacacaaucuccgaacagcaggagcaggagauuaucuucaaggaucuguuuccugugcucauugaacaacugaaaaagcaggaguucaucaaaauuguccgccuugacaagaaaaucgaagccuuucugaagggcgagaaugaagagggccagaucuucuguaacuaucccgagaaguuuaaaaagcucuaccacccgucugauauugaaguguucaaaaagaaaaucauuaaggacgagugggggaaugaaaaggucgugcugggaagcccucugaccaccuccaucaaaaaccccauggccaugcgggcccuucaccagcucagaaagguucugaauacacugauucucgauggccaaaucgacgagaaaacccgcauccauauugaaauggcucgggagcugaacgaugcuaauaagagaaaagggauccaggacuuucagaaggagcgcgaggaacuuuauaagauuuacgaagccaaaaucaaggagcuguaccaggugaaaacaggaaaggaacuccugcacgucacggaugaggaccugcaaaaauucgagugggcgcuugaacagaccaaggauggccggauuaucacaaaggaggaacucauuaaauauaagaucugggaggagcagaaccauaucugcauuuacaccgggaaaacaaucagcauugacucuuuucugggcggaaauccuaaguucgacaucgaacacaccauucccagauccaucagccaagauaacucucugaugaacaaaacgcucugugacaaggauuucaaucgguccgugaaaggcaagaagaugcccguugagcugagcaacuauaaugaaauccuuccucgcauugcccacuggaaaaagcaggcugaggaacugaccagacagaucgagacaauuucucggagcaucaaauccgccgcuaccaagguggccaaagacaagaacauuagaaagcgccauuaccucacacugaaacgggauuauauccaggggaaguacgacagauuuaccuggggagagccgaaagucggcuucaagaauagccaaauccccgauacggggauuaucacaaaauaugcgcaggccuaccugaagucuuacuuuaagcgcguggaauccgugaaaggaggcgcuguugccgaguucagaaaacuuugggggauucaggagagcuuuaucgacgaaaacggcuucaagcacuuuaaggaaaaagaucgguccaagcauacccaccauacaauugacgcuaucaccauugccugcaugccuaaggauaaauaugaccugcucgcccacgcuuggcgccuggaggaugagcagaauaagaaagcggccaaggcucucaucgaacaagccaaacccuggaagaccuucaaagaggacaucgaaaagauugaggccgaaauccuggucucucacuuuacaccugacaacgugaagaaacaggcuaagaaaauucuuagagugcggggaaagaaacaguacgucgccgagaucgagcgcaaugcgaacggcaaggcuauucccaagaaagaugccagcgggaagaucaucuauaaacugaaugaaagaggaaacaagauuccgauccuccagcaaggcgacacgauucgggggucccugcaucaggauucuaucuacggagccauuaaaaauccucugaacaccaaugagauccgcuaugugaucagaaaggaccuugaaagccugaaggcuaacgauauugagaacaucguugacgagaaugugaaagccaaggucaaagaagcgguggcuaacaagauucuccugaucuccucuaauccccagcagaaaaacaaguucgccgagggcaagaauguuuggaugaacgaagagaaaaagauuccuaucaauaaagugcggauuuacgccaacagcgucaagaaucccaucgaaaucaaaaagcacuccacacucagcaaaucuaagcaugagcacaagcagaccguguaugggcagaacgaugagaauuacgcuauggcccuguacgaacuugacggcaaacgcgaguuugaacugauuaacaauuucaaccucgcuaagcugcugaaacagggacaaggcuauuacccucuucacaaggagaaagaaaucaaggggaagaaaguucugauucccaucgagaagagaaauaaccgggaugugguccucaaaagaggacaacaggugguguucuaugacaagacagucgaaaauuccaaagauauuagcgaaaucguugacuuucgcggccggguguaccugaucgaggggcucaccauucagagacaaaaggacaagaaaacgggaaaggugaacgaauauggcaucauucagcugcgcuacuucaaagaggcccggaagucugaagagaucuccaaagauagcuuuaagccggacggggaguucaagauuaacgaaaauaaaccuacaagaaagaugaaccauaaucaguuuaccgcguucgucgagggcaucgauuuuaaagugcuucccucuggaaaguuccagaaaaucuga

SEQ ID NO: 4566 - RNA, 4464 nt, Artificial Sequence
  Cas9 variant
augaagaacgugcugggccucgaccuggggagcaauuccgucggaugggcccuuguuaaaaccgaggauaacggcaaucccaucgggucuauuaagaugggaagcagaaucauuccuaugucccaggacauccugggcucuuucgaaaaaggggauacagugagccaaacggcucagcggacccucuaccgcggaaagagacggcugauugagcgccacgugcuuagacgggaacgccugugcagaguccuccauaucaugaacuuucugccggaccacuucgauaaacugcucggcugggacaagacagauaauaagaccuauggcaaauuuaucgacgauuccgagcccaagcuggccuggcggcagaacaaaaaugaaaaggagaaaauggaguucguguuuauggacucuuuccaugaaaugcuuagcgauuuugcgaagcaccagccucaacugauugcuaacgggaagaaaguuccccucgacuggacaaucuacuaucugcgcaagaaagcccuuacccagcugauuuccaaggaggaacucgccuggauccugcugaauuucaacaaaaagagaggauacuaucagcuccggggcgaggaggaagaggaacagccuaccaaaaaggaggaauacaaggugcugaaagucauuagcguggaugcugacgaggggcaaaagggaaauggcaucugguauaacauucaucuugaggacgggggaaucuacaaacgcaagucugauacaccccuguacgacuggguuggcaaaacgcuccagcugaucguggucaccauuuaugaaaaggauggcaagacaccuaaaaucuuugacuccgggaagcagaauccgagcuacagacuucccaaagaggaugacuggggacugauuaagaaacggaccgaaucucagauccaauccagcggcaagacagugggggccuucauuuaugauaacauccucucuaagccugacgauaaaauccgcggaaaucuggugagaaccauugagcggaaguacuauaaaaaggaacugaucgagauucuccagcagcaagcuaaauaccacgacgagcugcacaaccagaaccuucuggaauccugugccaaggagcucuaugcgcauaaugaugucagauacaacgaaguugucaagagcaauaugauccaccuucuuguggacgacauuaucuuuuaccagcgcccccugaaauccaagaaaucucucaucgccaacugcaaguaugagagcuacgaauauguggauaaagagacgggcgaggugaaggaaaugccuauuaaauguaucgcuaaguccaaucccuacuaucaggaguuccggcuguggcaauuuauucauaaccugagacucagcgacguugugacacgcgaagaugucaccgcccaguaccugucuacaccgcaggacuauugcaaucuuuucaccuaccugaacgaucggaaggagaucaaacaggacauucuccugaaggauuucuuuaaaaucaagaaagugcaaauugacaaggagaagguuuucccuaucgaauggaauuacaucaaagaugcuaccaagacauaucccuguaacgagacgagauacgaacugcuuuccgcccucaaacgcgcggggauggacaagcaguggcuggaugacaccccuaauaugcaguaucggcuguggcaccuccuguacagcguggaggaacaggaggagucugccaaagcucuuagaaagcuguaugauaacgacaauuuugucagcuccuuccucaagauuaaacccuuuaagaaaugcuacggagccuauucugaaaaggcuaucaaacgccugcugacacuuaugcggaugggcaaggccugggacgagcaagccauugaugcuaagacccucaaauguauccagcagauuaucacaggcaacaucgacagcaagcugaaagaaaagauugaugacuccagauacgugcugcaccaugucagcgauuuccaggggcuccccaccuaccuggcgucuuaugugaucuacggacgccacuccgagguuacggacauucggugcugggauacaccuaaagaccuucugaaguuuaucuguggcuucccgcaacauagccucagaaaucccauuguggaacaggucauccuggagacccugcgggugguuuaugauaucuggaaagccgagaagcacauugacgaaauccauguggaggucgcucgcgaaaugaagcugaccgcccagcaaagaaacgaggccaaccuccggaaucugaacaaugaagcuacaaaccugagaauuaaauaccuccuggaggagcuuaagaaugauaccuuuaucaaagacgugcgcccucugucucccaugcaccaggaaaagaugcggauuuaugagcaggccgugcucgggaaccugaauaaacaggauaaggacuacgacgauaucaucaagauuuccaaaaaggaaagaccuacaagcgcggagcugauccgcuauaaacuuuggcucgagcaaaaguacugcucccccuacacgggaaaagcuauuucucugagcaagcuguucaccacagccuaucagaucgaacacguuauuccgcaguccagauacuuugacaacucuuucaauaacaaggucaucugugagagcgaagugaauaaagagaaggauaaaaugcucggcuaugaauuuauuaaggggcggggcggagaccgcaucuacugcaccgcccauggcaaagaggugacaauccugaaggaggaagaguauaagcaguucgucaacgaacacuacgcucauaauaaaagaaagcgggauaaccuucuggccgagaauauuccugaauccuucagcucucgccaacucaacgacaccagauauaucacgaaaaccauuaugucccugcugagcaacgugguucggcagcagggggaggaggaagcuacagccaagaaucuucugcccucuuccggagcggugaccgauaaacucaagaacgacuggggccugaaggaugucuggaauacaaucgugaccccucgcuuugagagacucaacaaacugagcgggacgaaugacuucggagaaaugaaggaggaaaacggcaaucgguacuuucagacaaacguucccucugaguacgagaaaggguucaagaaaaagcgcauugaucacagacaccaugccauggacgcucuugugaucgccugcaccacacggaauauggucaacuauaucagcaaugugaacgcuaauuccccuaaacaaagagaagaccugcgccagcuccugugugauaagaaccggauuaucaauaagcccuggaacaccuuuacccaggacgcccugaaagcgcuuaacgauauuguugugagcuucaagaauaacgucagaaucauuaaucgcgccacaaaccgguaccaaagauaugacaaaaauggcaagaaaaugaucugcucucagaagggaaacgauaugugggcuauccgcaaguccaugcacaaagagacgguguuuggccgggugaaucugauuagaaaggaagcccucccgaucgcuaaagcccuggacaacauuagcgccaucuguaaugcucagcuccgcgcguacgucaacgaucugguugacaagcauuucaauaaaaagcagcuuguggcccacuuuaagucccuggauuauaaauggaaccggcaagacgugucuaaggucgagguguggauuagcuccgaugacaaaaccccuaugguugcugugagaaagccccucgauacaucuuucgacaaaaagaagaucgccagcauuaccgacacagggauccaggccauccugcugaauuaccuugaguccaaaggaggcgaugcucuggucgccuuugcgcccgaagggauucaggagaugaacucuaauaucgaacucuauaacaauggaaaggcucauaaaccuauuaagaacgugcggcugagcgagacccucggcgccaaauaccagguuggggaacgcggcgccaagacgaaaaaguacguggucgcugacaagggaacaaaccuguucuuugccaucuaugaggaugaggaaggcaaaagauacuauuacuccgugccgcuucgggaggcgauugaacgccaaaagcagaaacugagccccguuccugaguauaaugaaaaggggguggcucugaaauucuaccucucucccaacgaccuggucuaugugccuaccgaggaggaaagaaccaugggaacaugccacaucgauaagacccggaucuacaagaugguguccagcucugagaauagauguugcuucguccccuccacaauugccaaaguuaucgccgacaagguggaacuucugagccacaacaaaauugagaaggcuaucacgggcgaaucuauuaaagagguguguuggaagcucaaggucgaucgccuggggaauauccucaacgugaucaaauga

SEQ ID NO: 4567 - RNA, 4464 nt, Artificial Sequence
  Cas9 variant
augaagaacgugcugggccucgaccuggggagcaauuccgucggaugggcccuuguuaaaaccgaggauaacggcaaucccaucgggucuauuaagaugggaagcagaaucauuccuaugucccaggacauccugggcucuuucgaaaaaggggauacagugagccaaacggcucagcggacccucuaccgcggaaagagacggcugacagagcgccacgugcuuagacgggaacgccugugcagaguccuccauauuaugaacuuucugccggaccacuucgauaaacugcucggcugggacaagaccgauaauaagacauauggcaaauuuaucgacgauuccgagcccaagcuggccuggcggcagaacaaaaaugaaaaggagaaaauggaguucguguuuauggacucuuuccaugaaaugcuuagcgauuuugcgaagcaccagccucaacugaucgcuaacgggaagaaaguuccccucgacuggaccauuuacuaucugcgcaagaaagcccuuacacagcugaucuccaaggaggaacucgccuggauucugcugaauuucaacaaaaagagaggauacuaucagcuccggggcgaggaggaagaggaacagccuaccaaaaaggaggaauacaaggugcugaaagucaucagcguggaugcugacgaggggcaaaagggaaauggcauuugguauaacauccaucuugaggacgggggaauuuacaaacgcaagucugauaucccccuguacgacuggguuggcaaaacgcuccagcugaucguggucaccauuuaugaaaaggauggcaagacaccuaaaaucuuugacuccgggaagcagaauccgagcuacagacuucccaaagaggaugacuggggacugauuaagaaacggaccgaaucucagauccaauccagcggcaagacagugggggccuucauuuaugauaacauccucucuaagccugcugacaaaauccgcggaaaucuggugagaaccauugagcggaaguacuauaaaaaggaacugaucgagauucuccagcagcaagccaaauaccacgaugagcugcacaaccagcaucuucuggaauccugugcgaaggagcucuaugcccacaacgacgucagauacaaugaaguugucaagagcaacaugauccaucugcuuguggaugacauuaucuuuuaccagcgcccccugaaauccaagaaaucucucaucgacaauugcaaguaugagagcuacgaauauguggauaaagagacgggcgaggugaaggaaaugccuauuaaauguaucgcuaaguccaaccccuacuaucaggaguuccggcuguggcaauuuauucacaaucugagacucagcgacguugugacacgcgaagaugucaccgcccaguaccugucuacaccgcaggacuauugcaaccuuuucaccuaccugaaugaucggaaggagaucaaacaggacauucuccugaaggauuucuuucaaaucaaaaaggugcagauugacaaagagaagguuuucccuaucgaauggaacuacaucaaggaugcuaccaaaacauaucccuguaaugagacgaaguacgaacugcuuuccgcccucaaaagagcggggauggacaagcaguggcuggaugacaccccuaacaugcaguaucgccuguggcaccuccuguacagcguggaggaaaaagaggagucugccaaggcccuucggaagcuguaugaugacgacaauuuugucagcuccuuccucaaaauuaagcccuuugaaaaaugcuacggagcuuauucugagaaggcuaucaaaagacugcugacacuuaugcgcaugggcaaggccugggaugaacaagccauugacgcuaagacccucaaauguauccagcagauuaucacaggcaacaucgauagcaagcugaaagagaagauugacgauucccgguacgugcugcaucacgucagcgacuuccaggggcuccccaccuaccuggcgucuuaugugaucuacggaagacauuccgaaguuacggauauucgcugcugggacacaccuaaagaucuucugaaguuuaucuguggcuucccgcaacacagccuccggaaucccauuguggagcaggucauccuggagacccugagagugguuuaugacaucuggaaagccgaaaagcauauugaugagauccacguggaagucgcucgggagaugaaacuuaccgcccagcaacgcaacgaagccaaucucagaaaccugaacaaugaggcuacaaaccugcggauuaaguaccuccuggaggaacuuaagaaugacaccuuuaucaaagaugugagaccucugucucccaugcaccaggagaagaugcgcauuuaugaacaggccgugcucgggaaccugaauaaacaggacaaggacuacgaugacaucaucaagauuuccaaaaaggagcggccuacaagcgcggagcugaucagauauaaacuuuggcucgaacaaaaguacugcucccccuacacgggaaaagcuauuucucugagcaagcuguucaccacagccuaucagaucgagcauguuauuccgcagucccgcuacuuugauaacucuuucaauaacaaggucaucugugaaagcgaggugaauaaagaaaaggacaaaaugcucggcuaugaguuuauuaaggggagaggcggagaucggaucuacugcaccgcccacggcaaagaggugacaauccugaaggaagaggaauauaagcaguucgucaacgagcauuacgcucacaauaaacgcaagagagacaaccuucuggccgaaaauauuccugaguccuucagcucucggcaacucaacgauacccgcuauaucacgaaaaccauuaugucccugcugagcaaugugguuagacagcagggggaggaagaggcuacagccaagaaccuucugcccucuuccggagcggugaccgacaaacucaagaacgauuggggccugaaggacgucuggaauacaaucgugaccccucgguuugaacgccucaacaaacugagcgggacgaaugauuucggagagaugaaggaagagaacggcaauagauacuuucagacaaacguucccucugaguacgaaaaaggguucaagaaaaagcggauugaccaccgccaucacgccauggacgcucuugugaucgccugcaccacaagaaauauggucaacuauaucagcaaugugaacgcuaauuccccuaaacaacgggaggaucugagacagcuccugugugacaagaaccgcauuaucaauaagcccuggaacaccuuuacccaggaugcccugaaagcgcuuaaugacauuguugugagcuucaagaacaacguccggaucauuaauagagccacaaaccgcuaccaacgguaugauaaaaauggcaagaaaaugaucugcucucagaagggaaacgacaugugggcuaucagaaaguccaugcauaaagaaacgguguuuggccgcgugaaucugauucggaaggaggcccucccgaucgcuaaagcccuggauaacauuagcgccaucuguaaugcucagcucagagcguacgucaacgaccugguugauaagcacuucaauaaaaagcagcuuguggcccauuuuaagucccuggacuauaaauggaaccgccaagaugugucuaaggucgagguguggauuagcuccgacgauaaaaccccuaugguugcugugcggaagccccucgacacaucuuucgacaaaaagaagaucgccagcauuaccgauacagggauccaggccauccugcugaauuaccuugaauccaaaggaggcgacgcucuggucgccuuugcgcccgaggggauucaggaaaugaacucuaauaucgagcucuauaacaauggaaaggcucacaaaccuauuaagaacgugagacugagcgaaacccucggcgccaaauaccagguuggggagcggggcgccaagacgaaaaaguacguggucgcugauaagggaacaaaucuguucuuugccaucuaugaggacgaagagggcaaacgcuacuauuacuccgugccgcuuagagaagcgauugagcggcaaaagcagaaacugagccccguuccugaauauaacgagaaggggguggcucugaaauucuaccucucucccaacgaucuggucuaugugccuaccgaggaggaacgcaccaugggaacaugccacaucgacaagaccagaaucuacaagaugguguccagcucugaaaaucgguguugcuucguccccuccacaauugccaaaguuaucgccgauaagguggagcuucugagccauaacaaaauugaaaaggcuaucacgggcgagucuauuaaagagguguguuggaagcucaaggucgacagacuggggaauauccucaacgugaucaaauga

SEQ ID NO: 4568 - RNA, 4464 nt, Artificial Sequence
  Cas9 variant
augaagaacauccugggccucgaccuggggagcaauuccgugggaugggcccuugucaaaguugaggaaaacggcaaucccauugggucuaucaagaugggaagcagaauuaucccuaugucccaggauauucugggcucuuucgagaaaggggacaccgugagccaaacagcucagcggacgcucuaccgcggaaagagacggcugaucgaacgccacgugcuuagacgggagcgccugugcagaguccuccauaucaugaacuuucugccggcccacuucgaucggcugcucggcugggacaaaaccgauaauaagacauauggcaaguuuauugacgauuccgaacccaaacuggcguggcgccagaacaagaaugagauggggaaaauggaguucguguuuauggacucuuuccaugaaaugcuuagcgauuuugcuaagcaccagccucaacugaucgccaacggcaaaaagguuccccucgacuggaccauuuacuaucugagaaagaaagcccuuacacagcugaucuccaaggaggaacucgcuuggauucugcugaauuucaacaaaaagcggggcuacuaucagcuccgcggggaggaggaagaggaacagccuaccaaaaaggaggaauacaaagugcugaaggucaucagcguggaugccgacgagggacaaaagggcaaugggauuugguauaacauccaucuugaggauggaggcaucuacaaaaagaaaucugacauuccccuguacgacuggguuggcaagacacuccagcugaucguggucaccacguaugaaaaagaugggaagaccccuaagauuuuugacuccggaaaacagaauccgagcuacagacuucccaaggaggaugacuggggccuggugaaaaagcggacagaaucucagcuccaauccagcgggaaaaccgugggagcuuucaucuaugauaacauucugucuaagccugacgauaagauccgcggcaaucuggucagaacaaucgagcggaaauacuauaagaaagaacucauugagauccugcagcagcaagccaaguaccacgacgagcuucacaaccagaaccugcucgaauccugugcgaaagagcuguaugcccauaaugauguucacuacaacgaagugauuaagagcaauaugaucaaccuucuggugaaugacauuaucuuuuaccagagaccccucaaguccaaaaagucucugaucgcuaacugcaaauaugagagcuacgaauaugucgauaaggagaccggggagauuaaagaaaugccuaucaaguguauugccaaauccaaucccuacuaucaggaguuccgccuguggcaauuuauccauaaccuccggcugagcgacgugguuacgagagaagacgugacagcucaguaccuuucuaccccgcaggauuauugcaaucuguucacauaccucaacgaccgcaaggagauuaagcaggauauccugcugaaagacuucuuuaagauuaaaaagguccaaaucgauaaagagaagguguucccuaucgaauggaauuacauuaaggacgccaccaaauccuaucccuguaacgagacccgguacgaacuucucagcgcgcugaagagagccggaauggauaaacaguggcuggacgauacaccuaauaugcaguaucgccucuggcaucugcuuuacucuguugaggaaaaggaggagagcgcuaaagcccugcggaagcucuaugacgaugacaaguuugugacguccuuccugaaaaucaagcccuuuaacaaaugcuacggcgcuuauucugaaaaggccauuaaaagacugcuuacccucaugcgcaugggcaaggccuggaaugagcaggcuaucgaugcgaagacacugaaauguauucaacagaucaucaccgacaacgucgacagcaagcugaaagaaaagauugaugacucccgguacgugcuccaccacgucagcgauuuccaggggcugcccacauaccuugccucuuaugugaucuacggaagacacuccgagguuaccgacauucagugcugggauagcccugaagaccugcucaaauuuauccgcgauuucaagcaacauucucugcggaacccgauuguggagcaggucauccuggagacgcuuagagugguuuaugacaucuggaaagcugaaaagcacauugaugagauccauguggaagucgcccgggagaugaagcucacagcccagcaacgcaaugaagcuaaccugagaaaucugaacaaugaggccaccaaccuccggauuaaauaccugcuugaggaacugaagaaugacaccuuuaucaaagaugugagaccccucuccccuauucaccaggagaagaugcgcaucuaugaacaggcggugcugggcaaccugaauaaacaggacaaggauuacgacgacaucauuaagaucagcaaaaaggagcaccccacaaacgcugagcuuauucgguauaaacucuggcuggaacaaagauacuguuccccuuacaccgggaaggccaucucucugagcaaacucuucacaacggccuaugagauugaacauaucauuccccagucccgcuacuuugauaauucuuucaacaauaagguuaucugcgaggcugaagucaacaaggccaaaggaaauaugcugggcuaugaguuuaucaagaaacaagggggccagaagauuuacuguacccagcuuggaaaagcugugacaauccugaaggaggaagccuauaagcaguucgugaacgagcacuacgcgcauaacaaaagaaagcgggacaaucuccuggccgaaaacauuccggagagcuucuccagccgccagcugaaugauaccagauauaucacaaaaaccauuaugucucuucuguccaacgucgugcggcagcaaagcgaagaggaggcuacggccaagaaucuccugccuucuuccggcagcguuaccgaccgccucaaaaacgauugggggcugaaggacguguggaauacaaucgucacccccagauuugaacggcuuaacaagcugucuggaacaaaugauuucggcgagaugaaagaagagaacgggaaucgcuacuuucagaccaacgugccucucgaauacgagaagggauucaaaaagaaaagaaucgaccaccggcaccaugcuauggaugcccugguuauugcgugcacgacacgcaauauggugaacuauaucagcaaugccaacgcuaacucccccaagcagagagaggaccugcggcaacuucugugcgauaaaaauagaauuaucaacaagccuugggacaccuuuacacaggacgcccucaaggcucugaaugauauugucgugagcuucaaaaacaauguucgcaucaucaaccgggccaccaauagauaccagcgcuaugacaagaacggcaaaaagauuaucuuuucucagaaaggggaugacaugugggccauucggaaguccaugcacaaggaaaccguguucggcagagucaaucucauccgcaaagaggugcugcccauugcuaaggcgcuugauaacaucagcgccauuuguaaugcucaacugcgggccuacgugaacgaccucgucgauaaacauuuuaauaagaaacagcugguugcccacuucaagucccugaacuauaaguggaauagacaggacgugucuaaaguggaagucuggaucagcuccgauaacaagacaccgaugguggcuguucgcaaaccucuugacacgucuuuugauaagaaaaagaucgccagcauuaccgacacaggaauccagaccauucugcucaauuaccuggaguccaagggcggggaugcgucuguggcuuucgcccccgagggaauccaagaaaugaacagcaacauugagcucuauaauaacggcaaagcccauaagcccaucaaaaauguccggcuguccgaaccucuuggggcuaaguaccaggugggagagagaggcgccaaaacaaagaaauacguugaagcggacaaggggaccaaccuguuuuucgcuaucuaugaggacgaggaaggcaagcgguacuauuacagcgugccgcugcgcgaggccauugaaagacagaaacagaagcucucucccgucccugaguauaaugaaaaaggaguggcccugaaguucuaccuuucccccaacgaucugguuuaugugccuacggaggaggaacggacaaugggaaccugccacaucgacaaagcucgcauuuacaagauggucagcucuaccggguguuccugcuacuuugugcccagcacauucgccaaggugaucgucgauaaaguugagcuccaaucucugaauaagauggaaaaagcuauuaccgacgaguguaucaaggaagugugcuggaaacucaagguggauagacugggaaacaucauuaaugucaucaaguga

SEQ ID NO: 4569 - RNA, 4485 nt, Artificial Sequence
  Cas9 variant
augaagaacauccugggccucgaccuggggaccaauagcauuggaugggcccuuaucgauaacgagucccacagaauuaucaaaucuggcagccggauuauccccauggacgcugccacaaugggggauuacgaaaagggaaaucugaaauccgcggacuggaagcgcacgucuuucagaggcaugcggcgccucuaugagagagcuaaacugcggcgcgaaagacuucugcgggugcucaacauccugggguuucugccugaggaguuccgcagacagauugauuuugaacaucacccgggacaauucaucgacggcaaggagccccucauugccuaccaucacgaugaaaauggccagcgggucuuuagcuauauguccgccuucgaggaaaugcugaccgacuuucgcgcuacacagucugagcuuguuagagaugggcggcgcgugccuuacgacuggaccaucuauuaccugagacauaaggcccucacacagcccgugaccaaagaggaacuggcuuggauuauccuuaacuucaauacaaagcggggauauuaccaacugagaagcgaguccgaagaggucaccacgaacaaaaaugaagaguacgccgagcucaaggugguuagcguggaaaagaccggcgaggauaagaagcgcgcgggguauuacugguauacaauuaccuacgacaacgaagccgagcagaaaaucacaucuaccaucccuccccggcagauuggagauaaggucgaacugaucgugacgacagcuagagacaaagccggcgagauuaagaaauccguucgcagcccuaaggaggacgauuggacccugaugaaaaagcggacagaacacaauaucgaggaagaggaaugcaccguggggucuuauauuuaccagcacauccucgcugacccgaccgucaaggugagaggaaaacuggugcauacaaucgagcgcaaguuuuauaaaaaggagcuuaaacaaauucugaacaagcagaaggaguucauccccgaacuccaggaugccucccuguacgaagcguguauuaaagagcuuuaccggaauaacgaggcccacauccagagcauugcuaauaaggacuuuacggaucuguucgucaacgacaucaucuuuuaucaaagaccucucaaaucuaagaaauccaccauuagcaacugccccuacgaauccuauuacuauaagaauaaggagacaggcgaacugauccgcaaaccuauuaaguguaucgccaaaucuaacccccuguaccaggaguuccggcucuggcaguucguucauaaucugagaauuuauaagaaaagcgaagagguguccggccgccuucaaaccgauguggacgucacagaucgguuucugaccacgccggacgauuacgcuaaacucuucagcuggcugaacgacagaaaggagaucaaacagaaggaacuucugcgguacgaggccuuugggcucucuaaauccuauggagacuaccgcuggaauuucguggaagauaagccuuaucccugcaacgagacacugcacgaaauuaauagacggaugaaaagcauccugucugacaagaaacucagcuccgaggccuaccagcagcuguggcacauccuuuauucuauugaugacccuaucgagauuagaaaggcucugaccagcuuugcgcaaaaccaggaaaucaauuccgaugacuucguuaacgccuuuuaccaguaugugcccgagaagaccaaaagcuacggcgcuuacucugaaaaggccauuaaaaagcuccugccccugaugcgccggggguccuauugggccaucggaaauaucgaugagaaaacacauagacgccuugacaacauuaucaauggcgucgcugaugacagcauuucuaccuguacaagagaaaagcucaacaaucugacggauaucaccaugugccaggggaugccucuguggcaagccuguuacgcgguguaugaccggcacuccgaggcugccgauacaaccaagugggagcagccggacgacauugauacauaccucagcaccgaacugaaacagcauucccuucgcaaccccaucguugagacggugaucucugaaacccugagagucgugcgggacauuuggaaggccuauggacgcccugaggagauccacgucgaacucggcagaaaccugaaacaggaugcuaagagccggaaacaagacgccauucgcauggcugagaaugaacagacaaaccugagaauccgggcccuucuccaggagcuguccaaucccgaaugcggcguggagaacguucgcccucauucucccagccagauggagcugcucaagauuuacgaaaaugaggugcugcaauccaccgaugacaucccggaagagaucagcaacauuaucaaggaucuugggaaaacagacucuaagaaaagaccuucccugagcgauauuaccaaguaucggcucuggcuggaacagaaauaccagucucccuacacgggacacaucauuccucuguccaaacuuuucacacccgcguaucaaaucgagcacgucauuccucagagcagauacuuugacgauucuaucagcaauaaggugaucugugaggccgaaguuaacaaagagaaggaccgcaugcucggcuaugaguucauuaucaauaaagggggauccauugugaagggcagcuuugggcagcaguucaaaaucuuugauaagguccaauacgaagacuucgugaaacagcgguaugcucauaacaagaccaagaugaaaaagcugcugauggacgauauucccgacggcuucauccagagacagcucaaugauucucgcuacauguccaaaaagaucauuagcauccuguccaacauugugcgggaagacggagagaaagaggccacaucuaagcacaucauuguuaccagcggcgcuaucaccgauagacuuaagaaagaaugggggaucaaggacgucuggaaugauauuaucgccccgcgcuuuaaacggcugaacaagcucacagacuccaauaacuauggaauggagacggaaaaagagggcagacaauacuuccagauuaacgugccuaccgagcugucuacagggcugaucaagaagcgcauugaucaucggcaccacgcgauggacgccaucauuaucgcuugcaccacaagaaaucaugugaacuuucuuaauaacagcaccgccgcuuccgaucagaaagacauccggcgcgaccuccagcacacgcuguguacaaagaccaaaaccgauucuaauggaaacuacgucuggagauucaauaagcccugggacacauuuacccaagauacacggcaggaacuggagggcauuaucgugagcuucaaacagaaccuccgcauuaucaauaagauguccaacuauuaccaacauuauguugacgggagaaagacgauuagccggcagaauaaaggcgauggaugggccaucagaaagucucugcacaaagccaccguguccggcaaggucaaccuuaaacgcagcaagacagugggguuuaaggaagcucugaaugacuggucugcgaucaaagauaagaccuccaaagccauucuccagaagaucauugcucaguacaaaaacuaugaccccaagacaaucuucaaauacuuuaaggaucggaauuucaagguugagggaaaagacuuuagcaagcuggaaguguauuacaacaccucugauaaagagccuauguccgcccauagagucaacauugacacgaccuucgaugagaaggaaauccgcagcaucacagacaccggcauucaaaagaucaugcugaagcaccuucacacauacgacgaugcccaggggaagacccauccggaggcugccuuuucccccgaaggaauugagaaaaugaaucagaacauccggaugcugaauggcgggaaggaccacaaaccuauuuucaaggugagaaaagcggaaauccucggcaugaaguucgcuguuggagagcgcggccauaaggauaaaaaguggguggaggccgacaaagggacaaaccuguuuuucgccauuuaugaaagcgaggaaaauaagcggucuuacagcuccaucccccucaacgaggcuaucgauagacugaaacgcggagaaaauauugccgacgagagagaucagaacggcaauaaacuucuguuuguccucucuccuauggaccugguguaugugcccgauccugacgaugcgcacaucgacgaggucaaggggaacaauaacauuuucaagaugguuagcugcaccggaacggaaugcuacuuugugcccgagacauaugcuaaugugaucuguaagggcaaagaacuggaguccaagaacaaagucgagucuuacgaugggauuaauaucaagaaaagcugcuauaagaucaccguggaccggcuuggcaagguucgcaaaauuuucaagggauga

SEQ ID NO: 4570 - RNA, 4491 nt, Artificial Sequence
  Cas9 variant
augaagaccauccugggccucgaccuggggacaaacagcauuggaugggccaaagugugcgucgaugacaauggcaacuaccuuagagauaucaagcuggggucccggauuauccccaugucucaggacguucucggaaauuucgauaaaggcgugacggagagccaaaccuccgugcgcacaggguuuagaggaguccggcgcauuagagaacggucucugcuucgcagagagcggcugcaccgcgugcuccauguucugggcuaucugccuccgcacuacgacagcgcuaucggcuggaacaagaaugaacccuccaccuaugggaaauuccucaaccauggagagccuaagcuggccugggaacacaaggaggauggcucuaugagauuucuuuucauggagagcuuucaugaaaugauggcggacuucgcuaaaucccagcccagccuggugucugaugggaagaaaaucccucucgacuggacaauuuacuaucugcggaagaaagcccuuucccagcccauccgcaaggaggaacuggccuggcuccugcugaauuuuaaccagaagagaggauacuaucaacuccggggcgaggaggaugacgauaauccuaccaaaugugaagaguacuacgaacugaaggucguggggauugaggcugacgaagagggaaagaacggcaauacaugguauaacguuaaacuugagaauggcuggaucuaccgcagacagagcaaaauuccgcuggacgauuggaucgggaaggugcgggaguucauugucaccacggaauaugaaaaagacggaaucacccucaagaaggauaaaaacggcgacgugaagagaucuuuucgcucccccagcgaggaugacugggggcugcggaaaaagagaacagaaaaacuucuggauucuuccaagaugaccgugggagccuucgucuacgaccaccuccuggcugagccuagcgauaagauccgcggcaaauuuauucggacaaucgagagaaaguauuacaaaaaggaacuguaugccauucucugcgagcaguccaaauaccacgaggaacugcgcucuggggacuaccuuaauaagugugcggaggaacuguauaagaacaaccagccccaucggaauagccuccugaccaaagaucuugccuaccugcuccuggaggaccugaucuucuaucaaagaccucucaagacgaaaaagucccugauugcugaaugccccuacgaggccuauaaauacguugacaaggaaacaggagagaucaagcgccagggcaucaaauguauugcuaagagcaacccguauuaccaggaguuucggcuuuggcaguucaucucuaaucugagacucuucaacaaagccgaugacaaggaagugaccgcggauuaccugccuacacaagacgauuaugugcgccuguuugccuaccuuaaugaccggaaagagauuaaccaggaaacccuccugaaggaguucuuuaaacugaagaagaucaccgucaauuccgaaaaaguguuccccauuagauggaacuauaucgaggauaaggagaaaaaguacccuugcaaugaaacacggcacgagcuccugcuugcucuggaccgcgccagaaucgaucauagcuggcucgaaaaacccggccaggaguaucggcuguggcaucugcuuuacucuguugaaagcaaggaggagacgaaggaagcucucagaaaacugaaggacgaugacgccuuuguggaguccuuccugaaagucaagcccuuuaaacgcgaauauggggccuacucugagaaggcuauuaagaaacuccuggcggugaugcggaugggaagccuuuggagagaaaccgauaucugugacacaaccaagggcaacauuacaaaaauccugcaaggggagauugacgagaagcucaaagaaaagaucuccgccagcguuucuuccuacaaucagcugagcgauuuccagggacugccuguguggcuugcuugcuaugucguguacggccgccacucugaggccgccgaaauucagcacuggaagaccccggagucccuccuggcuuauaucaacggguuuaaacaacacagccugagaaaucccaucgucgagcaguguauucucgaaacgcugcggacagugcaugacaucuggaaggagguuggccacauugaugaaauccauguggagcuuggacgcaacaugaaauccaccgccgaccagagagcgcggauuucugaaaauguccugcgcaacgagaacaccaaucucagaaucaagagccugcugcuugagcucaaaaacgauccuaauaucaaggacgugcggcccuacuccccuaugcagcaagaaaaacugcgcauuuaugaggaaggcguucugcaggagcucacaaaggaugacaaggauuucaccgaaaucacaaaaauuucuacgauggcucagcccagcgccaaggagcugcagagauacaaacuuuggcuggagcaaaaguaucgguccccguacaccgggaaaagcaucucucucacaaagcuguuuaccuccgccuaccagauugaacacgugaucccucagagccgcuauuucgacgauucuuuuuccaacaaggucaucugcgagagcgaagugaauagccugaaagacaacaugcuuggauacgaguucauuaagaaucacggcggggaaaucauucauuguacaaugcugggagaugugaaaguucucagcgaguccgaguauaaggcuuucgucaacgaccacuacgcccauaauaaaagaaagcgggaaaaccugcuccuggaggacaucccccaggaauuucuuaauagacaaaugaacgauagccgcuauauuucuaagguggugaaagcucugcucuccaauaucguccgggccgagggcgaggaagaggcgaccagcaaguucgugguuuccugcucugggggcaucacggacagacugaaaaaggauuggggacugaacgacguguggaauaaaauugucuacccucgcuuugaacggcuuaacagacugaccggcacagaggccuucgggcagugggaaaacaaggauggaaagcgcguguuucagaccgcuguuccccucgagcugcaacggggcuucaauaaaaagagaaucgaccaccgccaccaugccauggaugcucucgugauugccugcacaagccggaacaucauuaauuaucugaacaaugaguccgcgaacaauccuaaaaagagagaagaccuucggcagaaacugugugauaagaaccgcaccaucagaaagcccugggagacguuuacacaggacgccaccgcugcccucgaagaugucauugugucuuucaaaaauuacguucggaucaucaacaaggcuacaaauuacuaugagcgcuacgacguggaagggaaaaaggucauugccgagcagagaggagacgauaugugggccauccggaaaccgaugcacgaggcuaccuauuacggcagagugaaccugcgccggaagaaaaaggugaaucugagagucgcgcuugaaaacauuagcuccaucugcgacaauaagcugcgcauuuauaucaacgggcucguugagaaaggcuuuaacaccaagcaaauccuggauaaauucaagaauacaaacgaccauuuuucuaugcagaaaauugauaagguggaaaucuggcaguucacgaaugaggaagagaagcucguggccacccggaaaccucuggacacaucuuuugauaccaagaaaauugcuuccaucacagacaccggcauucagacgauccuucugaacuaccuggagacaaagggaggggauagcaccaucgccuucacccccgaaggaauugucgagaugaaucaaaacaucucuaaauauaauaacggcaaggaacacaugcccauucucaaggugagacuguacacaaaacuugggaagaaaaucccuguuggacagaccggcuguaaggccaaacaguucgugauugcugaggccgggacaaaucuguacuuugcgaucuaugaggacgaagagggcaagcgcuccuaccggacgauuccgcucaacgaagucguggagagacugaagcagggacucagccccguuccugagaaaaaugauaaggacgugcaucugaaauucuaucuuucucccaacgaucuggucuacgugccuaucgaagacgagcacgaaucccuggcuaaggaccacaucuauaaauuuguugauagcucuggcaccacagccaauuucauuccccaucgcuccgccaacgugaucuuugagcucaauaagaaagacgcugaaaaguucugcagcggguccauuauccaaaacgaguacggagucggcagcucucagagcaagaaucagaaagccauuaccggggaaaugaucaaggcgguguguagaaaacuggagguggaucggcuuggaaacgucaucaagguuauuuga

SEQ ID NO: 4571 - RNA, 4497 nt, Artificial Sequence
  Cas9 variant
augaagcacauccugggccucgaccuggggaccaacagcauuggaugggccgugaucagagcucaucaggaugccgacggccacacaacgcuucaagauauucuggcggcugggucccggaucauucccauggacgccgccacccucacagauuucgacaaaggaaaugcucgcucuggcaccgccgagagaaccagcuuucgguccaugcgcagacggcgcgaaagacagcugcuucggcgcgagagacugcaucggguccucaugcugcugggguuccucccucagcacuacgcuaacucucugacacgcuauggagaauuugccgauaauagagagugcaaacuuccguggguuaaagacgaaagcgauggcaaguaccauuuccuguuucaggacgcguuccacgagaugugugaggauuuucggcaacucgcuccccaguggguggcugacggcaaaaaggugccuuaugauuggacacuguacuaucuucgcugcaaggcccuguccagaaaaaucucuaaggaggaacucgcuuggauccugcugagcuucaaccagaaacggggguacuaucaggccagagacgaagaggacgaggucaccacgaauaagcucgaagaguacuacgcgggaaaagugguucgcguggaugacaccggcgaacggaaggggaagaacgucuauuacgauauuacacuggagaauggauggguguauagauacgccgcucgcaucuaucccgacuggguuggccaagugaaagaauuuauugucaccacaacccuuaacccugaugggacgcccaagacagacaaagccggagaggugaagcgguccuucagaaugccuaaagaugacgauuggacccugaucaagaaaaagaaggagcgcgacauugaucggagccaggaaacaaucggccaguacauuuaucacgcucuccugaaagacccgucucagaagaucagaggcaaacuuaucgggaccguggagcgcaaguacuacaaagacgaacugcggcggauucucgaucgccaaauccaguuucaucccgagcugcgggacagagaacuguauuacgccugucuccaggagcuguauccuuccaaugucgccuuccggaacacccuuguuaaucgcgauuuuacauaccuguuccucgacgauauucuguucuaucaaagaccccuuaagagcaagaaaucucagaucuccgacugcccuuacgaggaacacuuuuauacggauaaggagaccggagaacggauuagcgugcccgugaaauguaucgcugucucucauccgcuguaccaggaguacagacucuggcaguucauccaaaaccugcgcauuuauugccgggaagcgagaaucgacggcaaucugaugauugauugggaggugacaaacgagcuccugcagaccgaagaggacaagacagcccuuuuugauuggcugaaugacaaagaauccguuaagcagccugagcucguggcuuuccugcugggaggaaaggccaacaaaaagcagaucaaagccuaccgcuggaacuauauggaugacgacaccaagggcuaccccuguaaugagacgagagcuagccuucucaaauaucugcgggaagcccaaacagauuccucuuuucugacccgcgagagagaagaggcgcucuggcacauucuguacagcaucuccgacaagggggaacuuaagagcgcucugggaaaauucgccgucaagcacggccucaacgagcgguuugugaccguuuucucuaaauuuccucccuucaagaaagauuauggcuccuacagcgccaaggcucugaaaaagcugcuuccccucaugcgcauggggcaucacuggcaggaggccucuuuuaucccuagcacaagacagcggauggaaaaguucauuaauggagaguacgacgauuccaucgacaaacgcaccuaugaaaagcuggagucucugacagaagugagccaguacagaggccucccgggguggcuggcuugcuaugucguguacgaucggcauuccgagggacgcgacauugagagauggacgagccccucugauaucgacuccuaucuugcccaauuuaaacagcacagccugcauaacccuauugucgaacgggugguucucgagacccugagaacagugcgcgauaucuggaagcaggucgaccacauugaugaaauccacaucgagcugggccggaauaugaaacuucccgcggacaagagacgccagaugaccgaacaagccuggaagaacgagcagacaaaucuccggauuaaagcucugcugcucgaguucgccagaccuggguacgacaucgaaaacgugcgccccuauucuccguaccagcaagaucagcugcggauuuacgaggaagcuguucuuggcgccaaugaguguccugacgauaucuccgcgauucugaagaaauucaacggacucaaucccccuaccagcgccgaggugcugagauauaagugcuggcuggaacagaaauaccgcucccccuauacgggccggaccaucccucuuucuaagcucuuuacaagcgcuuacgagaucgaacauauuauccccaagcagagauauuucgacgauuccuuuucuaacaaagucauuugugagagcgaagugaauaagaaaaagggggccaugcugggauacgaguucaucaaauccuaucacggcgcuagcauuacccugaacagagggggaacagccucuaucuuuuccguggaggccuacgaaaauuucguuaaggagcauuacgcucacaaccgcggcaagaugaaaaagcuccugauggacgaugucccggacagcuuuaucucuagacaacuuaacgauucccgguauauuagcaaacugaugaagucuauccucagcaaucuggugcgcgaagagggggaaaaagaggcgauuuccaagaaccugaucgugugcaccggcggaauuacggacagacuuaaaaaggauuggggcauccacgacgucuggaaugacaucauuuucccucgguuuaagagacuggaugagauggacagcucucauacauacaucacccucaacacacaccgccaucccauucccuccaugccucuggaguuccagcggggguuuagcaaaaagagaaucgaucaccgccaucacgccauggacgcuauugugaucgccugcgccacccggaauauuguuaacuaucucaauaacgaauccgcuagacacgaugccaaaaccucucgcauggaccugcagcggcuucuguguacagcgaauagaaagcucaucgauaaaccguggaagacguucacccaggacacaugcaaggugcuggaagauaugaucgucagcuuucaacgcacccugagaauuaucaacaaaacaaagaauuacuaucuucgguucgaggacggaaagaagcgcagagugcugcagaccaaaggcgauaacugggcuauucggaagccccuccauaaggaaacguucuacggggagaucaaucugcgcagaauugagacacucucccugaacaaagcccuugaacggaucccugacaucguugagagagaucugcgcaagaaacucucugaacugcugagccuuggauauaaugccaagcggauuaaaggcuacuuugaggagcacaaggaagagugguccgacgugaaccugucuaagaucaaagccuacuauuucaccaagcagaaaaacaagagauacuuugccgcgcgcaccgaacucgacaccagcuucaauaaagauaagauugagaacaagaucgcugacacagccauucagaaaauccugcuccaacaucuggaagccuaugggaaugaugucgagcaggcuuuuucccccgagggcaucgacacaaugaaccggaauauuagacagcuuaacggaggccggagccaccaaccuaucuacaaggugcgcguuuaugaagaggccacgaaauucgcuguggggagacggggaaauaagucuaccaaauuugucgaagccgcgaagggcacaaaccuguucuuugccauuuacgagaucucccagguggaugggaauggaaaccgccagaccagcagaacauucucuuccauuccccugaauguggcugucgaacggcucaaacagggccugccucccguuccggaggacgaggaagggaacgccccuaaguaugugcuuagccccaaugaucugguguaccucccuaccgagaaggaacugaaacgcagagagaucgcuaugcccauugacaagucucggaucuacaaaauggucuccuguacgggcaaggauugcuuuuucaucccggccaacaccgccgugccuauuguugaccgcuaugaauacagcuccaugaauaaaaucgggagagcucucacaggcgagaugauuaaggagaucugucugccccuuaagauugaucggcuggggcaaaucaucgaaauuagcaccuucuga

SEQ ID NO: 4572 - RNA, 4506 nt, Artificial Sequence
  Cas9 variant
augaagaaaauccugggccucgaccuggggaccaacagcauuggaugggccgugaucaauaaggcugagaacgaaggcaaagauguccuuugcgggauugaggccgcgggauccagaaucauucccauggacgcuacaaucaugggcgauuucgaaaagggaaauucuguuagccagacgaaagaccggcgcgagcacagauccacccggcgccuguacgaaagagggaagcuccggcgcgagagacugaaccgggugcuuucugugaugggcuuucugccugaucauuaugucagccaacucgaccgcuacggcaaguuccuguccaauacagagccgaaacuggccugggugagaaacgccgauuguaaguaucacuuucucuucauggacucuuuuagcgaaaugcugcaggaguucaaaaccaauagcccccaguacaucagcgaagagucuaagguuccuuaugauuggacacuuuacuaucugcggaaaaaggcucucacccauaaggugacaaaagaggaacuggccuggauucuucugaacuuuaaucagaagcgcggguacuuccaacucagagacgaguccgaagaggagaaaaagcccagcaaaauccggcaguacuuugagcaccagaaggucguggauauuaucgacaccaacgagguuuauaaaggacugaaggugcugauugucauccucgcuaauggcauuucugggaagaucuucaaaaaggaaaucccugauuggauuggaguggagaaagacaucauugugaaggucgacaucgauaaagacggcaaggauaaguuuaacgaagacgggucccugagcugccgcuucaauauucccacggaggccgaaugggauaccgagugggagcuuaucaaacagaagacacaaaacgaccuggaugcgucuggaaaaaccguuggcgaauacaucuuugacacacuccugagaaauccugagcagaagauucggggcaaacuugugagaaccaucgaacgccgguauuacaaggaggaaauuaacgccauccugaagaaacagaaggaguuccauccggagcucuccgauagagcucuguaugaaaaauguguggaggaacuguaccccaacaauccugcccaccgcaacaugaugcucauucacgaccugagcuauuuccuugucaaugauauccuguuuuaccagcggccccucaaguccaaaaagucucugaucgacgagugcccuuacgagagccaucuuuauauugacaagaaauccggggaaagaaagcccguggcuguuaaauguaucgccaagagccacccgcuguaccaagaguuccgccucuggcaguuuauuucuaaccugcggaucuaucagaaaacgaaggaagugggaaauucccugaaagucgauguggacguuacaaacgaguuccucaagggcgaaaaugauuacguggagcuguuugacuggcuuaacaccaagaaagagauuaagcaagaagauuuccugaaauauaagccuuuuggguucacaaaaggaaauaucaacaauuacagauggaacuaugucgaggacaagauuuaccccugcaauaagacccauuacaccauccucaaaggccuggaaaaggcggauaucacauuugacgaguucauuagccacgauucucuggccgaagagaaccuuuggcacauccucuauagcguguccucuaaagaggaacugaagcaugcucuggagagcuuugccgacaaacgcgggcucuccauuaaguucgucgaugcuuuuaucaauacgccugccuucgaaaagagcuacggagccuauucugcuaaagcgauuaagaaacugcuuccccugaugcggaugggcaaguacuggaaagaggaaaacaucugugacuccaccagagagcgcaucgauaagauuaucacaggcgaguaugacgaaaacauucgggacagagugcgggaaaagagcaucaaucucaccgauauuacacuguuccgcgggcugccccuuuggcucgccugcuacguuguguaugacagacacucugaagcuggaaacaccgagcgguggacguccccuagcgauaucgaccauuacaucagaaaauuuaagcagcacucccugcgcaauccgauugucgagcagaucgugcuggaaacacuccggaccguuagagauguguggaccgaggucggcgggauugacgaaauccauguggagcugggacgcgaaaugaaaaaccccucugauaagagacggaaaaugagccuucagaugcaagagaaugagaacacaaaucugcgcauuaaggcccuccuggccgaguucaucaacccugagcugggcaucgaaaaugugagacccuacuccccuucucagcaggaccuucuccggcuguaugaggaaggggcuuggaacagccccgagauugaugagaaacagguugacgaaaugcuggccauccucaagaaguuuaaugagaccgauuccagcaaacgcccgacaaagucugaaauuaaaagauaccggcuguggcuugagcaaaaguaucgcuccccuuacacgggcacccccaucccucugagcaaacucuucacaaccgcguaugaaauugagcacgucauccccagaucucgguuuuucgacgauucccugacaaacaaggugauuugugagagcgaagugaauaagcugaaaggaaacaugcuuggcuacgaguuuaucaagucucacuauggggaaaaaguccagcucagcuccggaagcgaggugcagaucuucucuguuaaugacuacgagaaguuugugaaagaccauuacuccaagaacaaggcuaaaaugaagaaacugcugauggaugacauuccugaaaaguucaccgagcgccagaugaacgauagcagauauaucucccggcucauugucucucugcuuagcaauaucgugagagaaaaaggcgagcaagaauccauuucuaagaacguucuggugugcaccgggggagucacggaccgccucaagaaugauuggggcgugaacgacguuuggaauaaaaucauccugccccgguuuaagagaaugaacgagauuacagauagcaccgacuacacauccgugaauaccucugggcacaucauuccggccaugccucugcaucuucagaaaggcuucaacaagaaacgcaucgaucaccggcaccaugccauggacgcuauugucaucgccugugcuggaagaaauaucgugaacuaucugaauaaccagagcuccaagagcgaugugucucgccacgaccuccggaaucugcucugcgagaaggacaaauccgauagaaaggaacugauuaucaaacccugggacacguuuacacaggaugucuacagcguucuuucuuccauuaucgugagcauuaagcaaaaccugcgcgugaucaauaaaaccaagaacauuuaucagcggaaagaggacggcaaggucaucaucucuaagcaggaaaacaauauuaacuggugggccaucagaaaaccccuccauaaggagacaguguccggggaaguuaaucugcggaaagagaccaccauuagccugaaggaggcgaucgauaacccugcccgcauuaucgacaaagauuucaagaagaaacuuagagaacugauccucaugggauacaaugagaagcugauuaaaaaguauuucuacgacaacaaugaauccuggcaagaugugaaccucaaaaagaucccggcuuacuauuuuacaaaggacacgaaugaucgguacuucgccagccgcucucugcuugacgagaacuuugauaaaaagaaaauugaaaauaaggucaccgacacaggcaucagaaccauucugcuccggcaccuggagguggaagggggagacagcaaaguugcuuucucccccgaaggccuggagagaaugaacaagaauaucgaaauccuuaacgggggcaagaaacauaagccuauuuauaaagugcgcgaguacgagaaggccgaaaaauuugcggucggaaugcggggcaauaaggccucuaaauucguggaggcugccaaggggacaaaccuguuuuucgcuguuuaugauaauggaaagaaaagauccuuugccaccgugccccucaacgaagucauccgccugcagaaggagggccucccuuccgcccccgcuaacgaagaggggcugcuuccuaaauucgugcugucucccaaugaccugguguacgucccgacggaggaugaacuccggagcggacugcuuccugagaaccccgcgccugaaagaauuuauaagaugguuuccugcacaggcuaccagugcuuuuucauccacuucucugugagcggggugcugugugacaaaaaggaguuuuccagccucaauaagauggaacgcgccauuucuggcgagaugaucaaagagauuuguaucccccugaaggucaaccggcucggaaaaaucauguacaaucuguga

SEQ ID NO: 4573 - RNA, 4506 nt, Artificial Sequence
  Cas9 variant
augaagaccauccugggccucgaccuggggacaaacagcauuggaugggccaaaaucuccauugaugacaauggcaacuaccuuagagauauccagcuggggucucggauuauccccaugagccaagacgugcucggaaaguucgauaauggcgucacggagucccagaccgcuguucgcacaggguuuagaggacugcggcgcaucagagaacggucucuucugcgcagagagcggcuccaccgcgugcugcaugugaugggcuuccugccuccgcacuaugacagcgccauuggcuggaacaaagaggaacccuccaccuacgggaaguuucucaaucauggagaaccuaaacuggcgugggagagacagggcgaugggucuaugcgguuccuuuuuauggacagcuuccacaagaugauggaggauuuugcuccccaucagccugcccuggucgccgacggacgcaagaucccccucgauuggacacuguauuaccuuagaaagaaggcucugacccaaccuauuaaaaaggaggaacucgccuggauccugcugaacuucaaucagaaacggggcuauuaccagcuccgcggggaagaggaggaagagaacccgacaaagagagaagaguaucacgaacugaaggugguuuccguggaggcugccgaggaaggaaaaggcggcaauaccugguacaacgucaaacuugagaauggguggauuuaccaccggcccagcaaaaucgaccugucugauugggugggaaagacgaaacaguuuauuguuaccauggaauaugaggcggacggcaucacacucaagaaaaacaaggaaggggaggugaagagauccuuccgcgucccugacgaggaugacuggggacugcggaaaaagagaaccgaaagccaacuugaggccucuggcaaaacagugggggcuuuuaucuacgaucaucugcucgccgaacccgcugacaagauucgcggaaauuucauccggaccauugagagaaaauauuacaagcaggaacuggccgauauccugcgcgagcaguccaaguaucacgaggaacuccagagcaaaaagauucuggcggacugcgccgaggaacuuuaccggucuaaccaaccucauagagauucccugcucaaaaaggacaugguguaucugcuucugacggaucucaucuuuuaccagcgcccccugaaaagcaagaagucccugaucgcuaauuguccguacgaguauuacgaguaugucgacaaagaaacaggcgagauuaagcggcagggcaucaaaugcguugccaagucuaacccuuacuaucaagaguucagacucuggcaguucgugcugaaccuucgccuguacgaucggaccgaagacaaagaagugacagcugaguaucuccccagcaaggaggacuacgccagacuguuugucuaccugaaugaucggaaggaaauuaaccaggagacccuucucaaagacuucuuuaagcugaaaaaggugaaacagcgcuccgaaaaggaguucccuguuagauggaauuauaucgaagauaaagagaagaaguaccccuguaacgagacccggcacgaacugcucauggcccuggacagagcugggauggagcgcagcuggcuugaugacacagcgcggcaauauagacuguggcaccuccuguacucuauugaagugaaagaugaggccgaacgcgcucugagaaaacuuaaggacgaugacgaguuugucuccgccuuccucaaggugaaacccuuuaagaaggauuauggagccuacagcgagaaagcuguuaagaaacugcuggccgugaugcggaugggcucucauuggugcgaagacgauaucuguaaggagacgaaagaacgcaucgagcacauucuccagggggacgucgaggaaaagaucaaggagagaaugaaucauaccgcguauagccugggagaacuuuccgacuuccagggccugccugaguggcucgcuugcuacguggucuacgggcggcacucugaagccacagauauuaaacauuggaagaccccggagagccugauggccuauaucaacggcuuuaaacagcacucccugcgcaaucccauuguggagcaauguauccuugaaacacucagaaccguucacgacauuuggaaggaggcuggacauaucgaugaaauccacguggagcugggccggagcaugaaaucuacguccgaccagcgcgccagaaugacagaaaacauucugcggaaugagaacaccaaucuccgcaucaagagccugcuuauggagcugaagaacgaugcugacauuaaagaugucagaccuuacucucccaugcagcaggaaauccuccggauuuaugaggaaggggcccugcaagagcugaccaaggaagacaaugauuacgaggagaucuucaaaaucuccaagauuccucagcccagcgcgaaagaacuucucaaguauaaacuguggcuggagcagaaguacagauccccguauacaggaaagccuaucucucucagcaaacuguuuaccuccgccuaccagauugaacauaucauuccccaaucucgcuacuucgacgauagcuuuaacaauaaggugaucugcgaguccgagguuaacgcucuuaaaagcaacaugcugggcuaugaguucaucaagaaucacgggggagaaauugugcacuguacacuccugggcgacgucaaagugcagaacgaaucugaguacaaggccuucgugacggaacauuaugcuaauaacaaguacaaaaaggagaaacugcuuauggaggauaucccucaggacuuucugaaucggcaccucaacgacuccagauauauuagcaagguugucaaaacccugcucucuaauaucgugcgcacagaagaugagauggaaaccacauccaaguucguggucagcugcaccgggggcauuacggaccggcugaagaaagauuggggacuuaacgacguguggaauagcaucguuuacagcagauuugagcgccugaacgaacucaccaaguccgaugccuucggccggugggagaauaaagaggggaagagaguguuucaaacaagcgucccccuggaacugcagcgcggauucaacaaaaagcggaucgaccauagacaccaugcgauggaugcccuugugauugcuugugccucucggaauaucauuaacuaucugaauaacgaguccgcuaacagcccuaagaaacgcgaagaccucagacagcagcugugcgauaagaaucggaucauucgcaaacccugggaguccuuuacccaagacgccagagccgcucucgaagauguuguggucucuuucaagaacuacgugcggguuaucaauaaaacaaccaacuacuaugagagauacggcgcggacggggagaagacgauugccaagcagaaaaauagcgaaaugugggcugugcgcaagccgaugcacgaggccaaauauuacggacgggucaaccugcagagaaagacagaagugcgccuuaaagccgcucuggaggacaucccuuccaucugcaauaaggagcuccgggauuauauuaacagacuggugaaaucuggccugaaugcccgccagcuucuggcgcacuuuaagagcaccgacuacuguuggaacaagcaaaaugucgauaaaguugaaguguggcgguucuccgacgagaaggaaccccucguggcuaucagagagucucuggauacaucuuuugacgccaaacgcauugauaccaucaccgacacagggauucagaagauccuccugaacuaucuugaagccaaaggcggagaucccgcuaucgccuucacgccugagggcauugcggagaugaaucagaacauggcucuguacaauaacgggaagaugcaucagccgauccugagaguccggcucuccaagaaacgcggaaagaaauaccaagugggccagaccgggugcaaggccaaacaguuuguuauuagcgaaucuggaacaaaccuguauuucgccaucuacgaggacgaagauagaaaucggaccuauaacacaauuccccuuaaugagguggcugaacgccugaagcaaggccucuccccuguccccgagaagaacgagaaagaagugccucugaaguucuaccucagccccaaugaccugguuuaugugccuaccgaggaagagauccuuaugaaagaauguaagcugaacaaaaauagaaucuacaaguuuauugauucuuccgggacgacagccaacuucgucccccaccggagcgcuucucugaucuauaauguggacaagaaacucgccgaggcguuuugcaacgacgagauuauccagaaugaauacggcguuggauccccgcagagcaagaaccagaaagcccugaccggcgagaugauuaaggcuguguguuggaaacuugaagucgauagacuggggaauaucauucgcgugaucaaguga

SEQ ID NO: 4574 - RNA, 4515 nt, Artificial Sequence
  Cas9 variant
augaagaacaucgugggccuggaccucgggaccaauagcauuggaugggccgucguuaacggcaauaucaacgaugacggguccgagcagcuggugaaaauucaggcuucuggaagcagaaucauucccauggaugccgcgaugaucggcgacuucaauaaggggaacuccaucucucaaacagcugaacggacgcgccuuagagggauucggcgccugagcgagagauaccuccugcggcgcgaaagacuucaccggauccuggauauucucggcuuucugccuucccauuucgcccgcgaccuggauagauauggcaaaaucgugaaggacaaagagccgaagcucgccuggcggaagaaugaagcugggcaguuugaguucauuuuucagaacucuuucaaagagaugcuggaagauuuuaagcugaaucaccccaaccugaucaccgacgauaaaaaggucccuuacgacuggacaauuuauuaccuccgcaaaaagggacugaccagcaagaucuccaaagaggaacuugccuggauccugcucaauuucaaccaaaagagaggcuauuaccagcugcggggagaggaggaagaggaaaauaaaaacaaacagguggaguuuuaugcucugaaaguuauugccguggaagauagcggagagaagaaaggcaaggacacaugguacaauguccaucucgagaacggguggaucuaccgcagaaccucuaacaugccccuggacugggugggaaagacaaaagaguucauuguuaccacggaucuugaaaaggacggcaccccuaaaaaggauaaagaaggcaauaucaagcgguccuuuagagcgcccaaggaggacgauuggagccuggugaaaaagaaaacagaagccgacauugaucagacccacaagacagucgggaccuauaucuacgacacgcuccugggaaacccuucucaaaagauccgcggccggcuugugagaacaauugagcgcaaguauuacaaggaggaacugaaacucauccuggauaagcagaaagaguuccauccggaacugcaggaccgggcucucuaugccgcuugcguggaggaacuguacaccauuaaugaggcccacagaaacaauaucgggaaccgcgauuuuacauaucuuuuccuggaggacauucucuucuaccagcggccccugaaguccaaaaagagccuuaucgacaauuguccuuacgaagagaaccacugccuggauaaggaaaccggagagaucaaauuuuuccccgucaaguguauugcgaaaucucauccucucuuucaagaguucagacuguggcaguuuaucguuaaucugcgcauuuaucggaagggccucgcccaggacguggaugugaccaacgaacugcuuaaaacagaggaagacuacgucgcucuguucgauuggcucaaugggaagaaagagaucgaccaaaaggccuuucugaaguaucccccguucggacugaaaaaggaaguggagaacuacagauggaauuauguucaggauaaauccuacccuugcaacgagacgcgcagccuuaugcucgcucggcuggaaaagugugacauuuccaucgaguuucugaccaaagaaaaugaggaagcccucuggcacauucuguauucuguggaggauaagaacgagaucgucaaggcccuucagaaauucgcugacaagcauaaccugaaugcgagcuuuguggauguuuuccagaaauuucccuccuucaagaaagaauacggcagcuacucugccaaggcuaucaagaaacuccugccucugaugagaaugggcaaguauugguccgaggacagcauugauaaagggacacgggaacgcauggacaagaucauuaccggagaguacgacgaaaagaucgagaacagagugcgggagaaggccauucaccuugccgauaucucugaguucaagggccucccccuguggcuggucugcuauaucguguacgggagacacagcgaauccaaagaaauugcuaagugggagucucccgccgacaucgauagcuaucucaaauccuuuaagcaacauagccugcgcaauccuauugucgagcagaucauuaucgaaacacuucgggugguuagagacaucuggaaacaggugggaaacauugaugagauccacgucgaacugggccgcgagaugaagaauccggcggacaaaagacggaagaugacccagcaaauuucugaaaacgagaauacgaaccuccgcaucaaguaccugcugacagaguuccuuaaucccgaauaugagguggaaaacguuagaccuuacucccccagccagcaggauauucuccggaucuacgaggaaggggugcuuaauucugucuccaaccugccugaggagaucagcgacauucucaaaaaguuuaccgaaaccgaucugaaaaagcgccccuccagaucugaggugcuucgguauaaacuguggcucgaacagaaguaccgcagcccguauacaggcgaggugaucccucugggaaagcuguucacccccgcuuacgaaauugagcauguuaucccucaauccagauauuuugacgauucuuucagcaauaaagucauuugugaggccgaagugaacaaacuuaaauccaaucuccugggccacgaguuuaucgugaagcaucacggggaaauugucgagcugcccuucgggaaaaaggugaagaucuuuacaguugacgaguacgaacaguucgugaaagauaacuauagccggacgcgcggcaagaugaaaaagcuccuggucgacgacaucccugaggaauuuguggccagacagcuuaacgauucucgguacauuuccaaaguugucaagagccugcucucuaauaucgugagagagaagggggaagaggaggcuauuuccaaaaacgugauccccugcaccggaggcguuacagaccgccugaagaaagauuggggagugaaugacgucuggaacaagauuauccugccgcgguuccagagacuuaaugaacugaccggcacaaacaaauuuaccacgaugagccucaauaaccacgagaucccugccaugccccuggaacuccaaaagggauucaauaagaaacgcauugaucaucggcaccaugcuauggacgccaucauuaucgcgugugccaacagaaauauuaucaacuaccugaauaacgagucugcuaccgccaaggcugaacuuagccgcuaugaucugcagcggcuccugugcgacaaagccaagacagaugacaauggcaacuacaaaugggugaucagaaagcccugggcguccuucacccaggaugugcacgggguccuggaggacauuaucguuagcuuuaaacaaaaccuucgcgugauuaauaaggccacaaaccacuuccugcauuauaaugaggaaggaaagaaaaucuuugugaagcaggagaaaggcgacucuugggcuauucggaaguccaugcacaaagauaccgucuucggggaagugaaccucagacggaucaagacgguugcccugaaugaggcuaugaagaacccucagagcauuguggucaaagacuuuaagcgcaaacuccuggaacuucugaaucucggauucgaugccaagagaaucaaaaaguacuuugaggacaaccgggagacaugguccgauaucaaucugucuaagauuaccguguauuacuucagcaaagacacaaaggaucgcuuuuucgccaccagaaaaccgcuggacaccuccuuugaucggaagaaaaucgaaaacaauauuacagacacgggcauccagaagauucuucugagacaucucgagcugaaggauaacaaucccgacaucgcuuucucuccugaugggaucgacgaaaugaaccgcaauauuauccaacucaacaauggcaaauaucaccagcccauuaucaagguucggugguacgagcaggcggacaaauucgccgugggacagaccggcaacaagagcuccaaauuugucgaggcugccaaggggacaaaccuguucuuugccguguacgaaucuaauauucuugaugagaaaaccaacacaaucaucaagaagagaaauuaugcuaccauuccucugaacguugccaucgaacgccaaaaacagggacugagcguggcgcccgaggaagagaauggcaacgacccuauuuucguccucucccccaaugaucugguguaccuuccgacgacagacgagcuggcuaacgggguggucgcccagccucucgauaaggaacggaucuauaaaaugguuagcuguaccggaaaugagggccauuuuauucccgccagaaucgcuaacccuauucugcagaccaucgaacucgggucuaauaacaaggcccaaaaagcguggacagacgagaugaucaaggaaauuugcaugcccaucaagguggaucgccugggcaauauucuugaguccagcucucugcacaaaaaguga

SEQ ID NO: 4575 - RNA, 4515 nt, Artificial Sequence
  Cas9 variant
augaagaacaucgugggccuggaccucgggaccaauagcauuggaugggccgucguuaacggcuccgugaaugaugacgggucugagcagcuggugaaaauccaagcuagcggauccagaauuauccccauggaugccgcgaugauuggcgacuucaacaagggaaauucuaucagccagacagcugaacggacgcgccuuagaggaguccggcgccuguccgagagauaccuccugcggcgcgaaagacuucaccggauccuggauauucucggcuuucugccuuuccauuuugcccaggaccuggaucgccacggcaaaaucgugaaggggaaagagccgaagcucgccuggagaaagaacgaagcuggacaguucgaguuuauuuuccaagacucuuuuaaagagaugcuggaagauuucaaacuuaauuaucccaaccugaucaccgacgauaaaaagguuccuuacgacuggacaauuuauuaccuccggaaaaagggccugaccagcaagaucuccaaagaggaacuugccuggauucugcucaauuuuaaccagaagcgcggguauuaccagcugagaggagaggaggaagaggaaaauaaagauaagcugguggaguucuaugcucucaaagucguggccguugaagacagcggcgagaagaaagggaaggacaucugguacaacgugcaucuggagaauggaugggucuaccggcgcacaucuaacaugucccuugauugggugggcaagaccaaagaauuuaucgugacaaccgaccuggagaaggauggcacgcccaaaaaggacaaagaagggaaugucaagcggagcuucagagcgccuaaggaggaugacuggucucucguuaaaaagaaaaccgaagccgauauugaccagacacacaagaccgugggagcuuauaucuacgauacacugcuuggcaaccccucccaaaagauuagagggcgccuggugcggaccaucgagagaaaguauuacaaggaggaacucaaacugauucuggagaagcagaaagaauuucaucucgagcugcaggaccgcgcccuuuaugcugccugcaucgaggaacuguacccuaucaacgaggcgcaccggaauaacgucggaaauagagauuucacguaucucuuccuggaagacauucuguuuuaccagcgcccgcuuaagagcaaaaagucucucaucgacaacugucccuacgaggaaaaucaaggccuggauaaggagacaggggagauuaaauccuucccugugaagugcaucgccaaaagccacccccuguuucaggaguuccggcucuggcaguuuauuaucaaccugagaaucuaucgcaaggaccuugcucaagauguugacgugaccaaugaacugcucaaaacagaagaggauuacgucgcccuguucgacuggcugaacggaaagaaagaaauugaucagaaggcuuuucuuaaguauccuguguucggccucaaaaaggagaucgagaauuaccgguggaacuauguucaggacaaacccuacccguguaaugaaaccagaucccugaugcuggcccgccucgagaagugcgauauuucuaucgaauuucugaccaaagagaacgaagaggcccuuuggcauauucuguauagcguggaggacaagaaugaaaucgucaaggcucuccagaaauucgcggauaagcacgaccugaacgccuccuuuguggaugucuuccaaaaauuuccucccuucaagaaagaguacggcagcuacucugcuaaggccauuaagaaacugcuuccucucaugcggauggggaaguauugguccgaaaauagcaucgacaaaggaacaagagagcggaucgacaagauuaucacgggcgaauacgaugagaaaauugagaaccgcgugagagaaaaggccauccaucuggcugacguuucugauuucaaggggcugccccucuggcugguguguuauauugucuacggacggcacagcgaggccaaagaaaucauccaguggaagucccccgcggacauugauucuuaucuucgcagcuuuaaacagcacucccugagaaacccuaucguggagcagauuaucauugagacccuccggguugugagagacaucuggaagcaagucggcaauaucgaugaaauucauguggagcuggggcgcgaaaugaaaaacccggcugacaagagaaagaagaugacacagcagaugagcgagaaugaaaacaccaaucugcggaucaaguaccuucucacagaguuccugaaccccgaguaugaaguggagaauguucgcccuuacucucccucccagcaagauauucugagaaucuacgaagagggcguccucaacagcgugucugaccugccugaagagauuuccgauauccuuaaaaaguuuaccgagacggaccugaaaaagcggcccagccgcuccgaagugcucagauauaaacuguggcuggagcagaaguaccggucuccguauacaggagaagucaucccucuuggcaaacucuucacccccgccuacgagauugaacacgugaucccucagagcugcuauuuugaugacuccuucucuaauaaaguuauuugugaggccgaggugaacaagcugaaaagcaaucugcucgggcaugaauuuaucgucaagcaccauggagagauuguggaacugcccuucggcaaaaagguucgcaucuuuaccguggacgaguacgagcaguucgucaaggauaacuauuccagaacacggagcaaaaugaagaaacuucugauggacgauauuccugaagaguuugugacccgccaacucaaugacucuagauacaucuccaagguugugaaaagccugcugucuaacaucguccgggaaaagggggaggaagaggcuauuuccaagaaugugauccccugcacaggaggcgugacggauagacuuaaaaaggacugggggauuaacgaggucuggaacaaaaucauucugccgcgcuuccagcggcucaaugaacugaccggcacaaacaaguuuaccaccaaaaauguuggaauccaggagaucccuacaaugccccucgaacugcaaaagggcuucaacaagaaaagaauugaucaccgccaccaugccauggacgcuaucauuaucgccugugcgaaucggaacauuaucaauuaccuuaacaaugagagcgccacggcuaaggccgaacugucuagauaugaucuccagaaaaugcugugcgacaaggcuaaaaccgauaacaaugggaacuacaagugggugauccgcaaacccugggccagcuucacacaggacaccuaucuggcgcuugagaauauuaucguguccuuuaagcagaaccugcgggucauuaauaaggccacaaacagauuccuccacuacaacgaggaagggaaaaagaucuuugugaaacaaggcaagggggacaauugggcuauucgcaaaagcaugcauaaggauaccguuuucggagaggugaaccugcggagaaucaagacggucgcccucaaugaagcuaugaaaaacccucagucuauugugguuaaggacuuuaaacggaagcugcuugagcuguggaaucucggcuucgaugccaaacgcaucaagaaguauuuugaagacaacagagagacaugguccgauaucaaucugagcaaaauugagguguacuauuucuccaaggacaccaaagaucgguuuuucgccacacgcaagccgcuggacaccucuuuugaucggaaaaagaucgaaaacaauauuaccgacacagggauccagaagauucuucugagacaccucgagcugaaagauaacaaucccgacaucgcuuucagcccugauggcaucgacgaaaugaacagaaauauuauccagcucaacaauggaaaguaccaccaacccauuaucaaaauucgcugguacgagcaggcggacaaguucgccgucggccagacggggaacaaauccucuaaguuuguggaggcugccaaaggaaccaaucuguucuuugccguuuaugaaagcaacauccuugauaagaagacaaacaccaucauuaaaaagcggaauuacgcuacaaucccucugaacguggccauugagagacagaaacaaggccugcccgucgcgccugaagacgagaaugggaacgaucccaucuucgugcucuccccgaaugaccugguguaucuuccuaccgaugacgaacuggcuaacggaauuaucgcccagccccucgaucgcggccggauuuacaagauggucucuagcuccggggagcagugcuuuuucaucaaacauaucguugccaaugugcugguggacaaguuugaguucagcccucucaacaagauggaaagagcucugacgggcgagaugauuaaaaugaucuguauucccaucaaggucgaucgccuuggaaaugugcuggaaucuuccagcucuuauaaaaaguga

SEQ ID NO: 4576 - RNA, 4515 nt, Artificial Sequence
  Cas9 variant
augaagaacaucgugggccuggaccucgggaccaauagcauuggaugggccgucguuaacggcuccgugaaugaugacgggucugagcagcuggugaaaauccaagcuagcggauccagaauuauccccauggaugccgcgaugauuggcgacuucaacaagggaaauucuaucagccagacagcugaacggacgcgccuuagaggaguccggcgccuguccgagagauaccuccugcggcgcgaaagacuucaccggauccuggauauucucggcuuucugccuuuccauuuugcccaggaccuggaucgccacggcaaaaucgugaaggggaaagagccgaagcucgccuggagaaagaacgaagcuggacaguucgaguuuauuuuccaagacucuuuuaaagagaugcuggaagauuucaaacuuaaucaucccaaccugaucaccgacgauaaaaagguuccuuaugacuggacaauuuacuaucuccggaaaaagggccugaccagcaagaucuccaaagaggaacuugccuggauucugcucaauuuuaaccagaagcgcggguacuaucagcugagaggagaggaggaagaggaaaauaaaaacaagcugguggaguucuacgcucucaaagucguggccguugaagauagcggcgagaagaaagggaaggacaucugguauaaugugcaccuggagaacggaugggucuaccggcgcacaucuaauaugccccuugacugggugggcaagaccaaagaauuuaucgugacaaccgaucuggagaaggacggcacgccuaaaaaggauaaagaagggaacgucaagagauccuuccgggcgcccaaggaggacgauuggagccucguuaaaaagaaaaccgaagccgacauugaucagacacauaagaccgugggagcuuacaucuaugacacacugcuuggcaacccuucucaaaagauuagagggcgccuggugcggaccaucgagagaaaguacuauaaggaggaacucaaacagauucuggagaagcagaaagaauuucaccuggagcuccaggaucgcgcccuguacgcugccugcaucgaggaacuuuauccgaucaaugaggcgcaccggaacaaugucggaaacagagacuucacguaccuguuccucgaagauauucuguuuuaucaacgcccccuuaaguccaaaaagagccugaucgacaauuguccuuacgaggaaaaccagggccucgacaaggagacaggggagauuaaaucuuuccccgugaagugcaucgccaaaucccauccucuguuucaggaguuccggcuguggcaauuuauuaucaaucucagaaucuaccgcaaggaucuggcucaggacguugaugugaccaacgaacuucugaaaacagaagaggacuaugucgcccucuucgauuggcugaauggaaagaaagaaauugaccagaaggcuuuucugaaguaccccguguuccggcuuaaaaaggagaucgagaacuauagauggaauuacguucaggauaaaccguauccuuguaacgaaacccgcagccucaugcuggcccggcuggagaagugcgacauuuccaucgaauuucucaccaaagagaaugaagaggcccuguggcacauucuuuacucuguggaggauaagaacgaaaucgucaaggcucugcaaaaauucgcggacaagcaugaucucaaugccagcuuuguggacgucuuccagaaauuucccccuuucaagaaagaguauggcuccuacagcgcuaaggccauuaagaaacugcugccccuuaugagaaugggcaaguacuggucugaaaacuccaucgauaaagggacacgggcccgcaucgacaagauuaucacgggagaguaugacgaaaagauugagaacagagugcgggagaaggcuauccaccucgccgauguuagcgacuucaagggccugccccuguggcucguguguuacauugucuaugggagacacucugaagcgaaagagaucauccaguggaaaagcccugcugauauugacuccuaccugcgcucuuuuaaacagcauagccuucggaauccgaucguggaacaaauuaucauugagacccugagaguugugcgcgauaucuggaagcaggucggaaacaucgacgagauucacguggaacucggcagagagaugaaaaaucccgccgauaagcggaaaaagaugacacagcagauguccgaaaacgagaauaccaaccugcgcaucaaguaucugcuuacagaguuccucaauccugaauacgagguggaaaacguuagacccuauagcccuucucaacaggacauucugcggaucuacgaggaagggguccucaauuccgugagcgaucugcccgaggaaauuucugacauccugaaaaaguuuaccgagacggaucuuaaaaagcgcccguccagaagcgagauccugcgguacaaacucuggcuggaacagaaguaucgcuccccuuacacaggcgaggugauuccccugggaaaacuuuucaccccugccuaugaaaucgagcaugucauuccccagucuugcuacuuugacgauagcuucuccaacaaagugaucugugaagcugagguuaauaagcucaaaucuaaccugcugggccacgaguuuauugugaagcaucacggggaaaucgucgagcucccuuucgggaaaaaggugagaauuuuuaccguugacgaauaugagcaauucgugaaggacaauuacagccggacacgcuccaaaaugaagaaacugcuuauggaugacauccccgaggaauuugucaccagacagcugaacgauagccgguauaucucuaaggugguuaaaucccuccugagcaauauugugagagagaagggcgaagaggaagccaucucuaagaacgucauuccgugcacagggggagugacggaccgccugaaaaaggauuggggcaucaacgagguguggaauaaaauuauccuuccucgguuccagagacugaacgagcucaccgggacaaauaaguuuaccacaaagaacgucggccugcaagaaauccccaccaugccccucgagcugcagaagggauucaauaagaaacgcauugaccaccggcaucacgcuauggaugccaucauuaucgcgugugccaacagaaauauuaucaacuaccuuaauaacgaauccgcuacggccaaggcugagcugagccgcuacgaccuccagaaaaugcugugcgauaaggccaaaaccgacaauaacggcaauuauaaguggguuauccggaaaccuugggcgucuuucacacaggauaccuaccuggcccuugaaaacauuaucgugagcuuuaagcaaaaucugagagugauuaacaaggcuacaaaccgcuuccuccauuauaaugaggaggggaaaaagaucuuugucaaacagggaaagggcgacaacugggccauucggaaauccaugcacaaggacaccguguucggggaaguuaaucugagacggaucaagacgguggcucucaacgaggccaugaaaaauccgcagagcauugucgugaaggauuuuaaacgcaagcugcuugaacuguggaaccucggauucgacgccaaaagaaucaagaaguacuuugaggauaaucgggaaacauggucugacaucaaccuguccaaaauugagguuuauuacuucagcaaggauaccaaagaccgcuuuuucgcuacaagaaagccccuggauaccuccuuugaccggaaaaagaucgagaauaacauuaccgauacaggcauccagaagauucuucugagacaccucgaacugaaagacaauaacccugauaucgcguucucucccgacgggaucgaugagaugaaucgcaacauuauccaacucaauaacggcaaguaucaucagccuauuaucaaagugcggugguacgaacaggccgacaaguucgcugucggacagacgggcaauaaauuuagcaaguucguggaggccgccaaagggaccaaccuguuuuucgcuguuuacgaguccaacauucuugacaagaagacaaauaccaucaucaaaaagagaaacuaugccacaauuccccugaauguggcgaucgaacgccaaaaacagggacugccugucgcucccgaggaugaaaacggcaaugacccgauuuuugugcucucuccuaacgaucugguguaccuucccaccgacgaugagcuggccaaugggaucauugcccagccucucgaccggggaagaaucuauaagauggucagcuccucuggcgaacaauguuucuuuauuaaacacaucguugcuaacgugcugguggauaaguucgaguuuagcccccucaauaagauggagcgcgcccugacgggggaaaugaucaaaaugauuugcaucccgauuaaggucgaccggcuuggcaacgugcuggaguccucuagcucccauaaaaaguga

SEQ ID NO: 4577 - RNA, 4515 nt, Artificial Sequence
  Cas9 variant
augaagagaauccugggccucgaccuggggaccaacagcauuggaugggcccuuaucgagaaugauuucaaccggaaagaaggcaagauugaggcucuggggucccgcaucauucccaugucucaggacauccucggaaaauuugauagcggcgugacagucucccaaacggccgcgagaaccaauuaccgggggauccgcagacuguaucagcgggacaaccuucgcagagaacggcugcaccgcguucucaauauucugggauuccugccuaagcauuacgcugagucuaucgauuuugaagacagacucggccaguucaaaccggagacagaggugaagcugcccuaucggaaggauagcgacgauaacuaccacuuuauuuuccaggaauccuuuaaugagaugguggaagaguuccaauuuaaaaacccuucucuuuucuauaccaaggccaauggcgagcagagcaaaauccccuacgacuggacacuguauuaccuccgcaagaaagcccuguccaagaagauuagcaaagaggaacuugcuuggauccugcucaacuuuaaucagaagagaggguacuaucagcugcggggagaagaggaagccgauucuaaagacaagcuggaggaguaccaugcucucaaagucuccgaugugcaagccaccgaagacacaaacgcgaagggcaccugguauaauguuauucuggagaacggguggaucuaccgcagacagagcaaagacucucuuuucgauuggaagggaaagacgcgggaauuuaucgugaccacaucccuggagaaaggcggggccgucaagauugacaaagaaggaaaugagaagcgcagcuucagagcuguggauucugagaaagacuggaucgccauuaagaagaaaaccgaaaacgaucucgcuaacgccggcacaaccguuggcguguauaucuacgagacgcugcuucggaauccugaccagaagauuagagggaaacugaucaagacaaucgaacgcaaauauuaccucgaggaacugaaggcgauucuggccaagcagauccaagagcacgcugagcuccagaaccggucccuguacaaagauugcauugaggaacuuuaucagggaaaugaagcccauaagaacaauaucaaagagaacggcuucgacuaccuguuucucgaggauauuaucuucuaucaaagaccccuuaagagcaaaaaguccaccaucucuaauuguccuuacgaaagccgcgucuuuauuaaggacgggaaaaaggagauccagccgauuaaaugcaucuccaagagcaaccccauuuaucaggaauuucggcuguggcaguuuauccacaaucugaaaauuuacgagaaggaagcuaucgaugacggaaaaacagugaucaacaaggacgugaccaccgaguuccucaauacacaagaggccuaugccgcucuguuugaguuccugaacgauaaggcggaaauuucucagaaugcccuccugaaauacuuuaaacuuuccacgaacacccacagauggaauaacgucgaagacaaaaaguacccuuguaacgagacacgcagcgaguucaucaaacggcugucuaagauggauggcauugaccucgggaagacccugagccccgcuuuugaaaaaucccuguggcauaucauuuauucuguuaaggauaaaaagcaguacgugagagcccuugagacauucgccaugaaaaauggacucgacaucaaccaguuucgcgaaaauuucgagaaguucaagccuuaugauagcgcuuacggcgccuauuccgaaaaagcgcugaagaaagugcugccccucauccggagaggcaccuacuggaagaaagacgcuauuccggccgccguccaagagcggaucgugaacauuaugaagcgcaucgaaagcguugauuuuaaucuggagaagauugagaacuucgcugacgaugacaucccuaaacagcuucugaagucuuuugccaaagggaaggaucccaugcagggacucaauacguaucaggcuugcuacgccguguacaacagacacuccgaagucagcgacauccaacuguggaaaucuccugaggacauuacaaaguaucuggauuccuucaaacagcauagccuucggaaucccaucguggaacagguugugauggagacccucagagucgugcgcgacauuuggcaguacuauggcaacggggcgaaggauuucuucuccgagauccacgucgaacugggacgggagaugaagaaugacaaaaagaccagagaacgcauuucuaaaagcaucacagagaacgaaaauaccaacgagagaaucaagaauauucugaaagagcucaugggcgaugaagcccugcaaggggacauccggcccuacuccaagggccaccaggauauucuuaagcuguaugaggaaggaguguuugcuaacgccccugagacauacaaaaacaucaagauugacgauaucgaaaagauucgcaagaauaacucuccgagcaaauccgacaucguuaaguauaagcucuggcuggagcagggcuacaucagccccuacacggggucuccuauuccccuguccagacuuuucaccacagauuaucaaaucgagcauauuaucccucggagccgcuacuuugacgauucuaugggaaauaaaauuaucugugaauccgcugugaacgaggaaaagaccaauaaaacagccuaugaguucaucaaggaaaacgcgggcagaauuaucgaccucgggcagggaaaacaggucccccuguuugaccuggaggccuacgagagccacugccggggcuauuucaaggggaauaccaagaaacucaaguuucugcuuucugaagauauuccggagggcuucaucaaccgccagcugaaugacagcagauacauuuccaaagugguuacgagccuccugucuaacgugguccgggaagagggagagcaagaagcuaccuccaagaaucuggugccucuugugggcacaaucaccagcaaacucaagaaggauugggggcuggaggccaucugggacgaucugauugcuccccgcuucgaaagaaugaaccagcucacaaaauccaccgacuuucggaaggagguuaucgauggacauggcaauagauauuucauuaacacggucccugacgauaucaaaaagggguuuucuaaaaagcgcauugaccaccggcaucacgcccuggaugcccuugugaucgcuuguacaaccaaagaccacgugaauuacauuacaagccugaacacccagagaaacaaucgcucccucgucucuaagcugcggaagaucgaagagaaaaccaucaaggacaaaagaacaggacagcccaagacgauuaaaaucgcgaaggccuaccauaagccuuggcccaacuucaccaaagagacauuugaaaagcugagcaaaaccgugguuuccuucaagcaaaaucagcgcauuaucaacaaaacaaauaacaagaccuggggcugggagaagguggauggggucaugaaaaaggugcuuaaaaagcaggaaaaacggaauugggcuauuagaaagccgauccacaaggagacguauuacggcaaaguuaagggauuugacucuccuaaaggcaagaucacaaccgccacccgcaaaagccugcgggaaauuacaaacgagagacagcucaauaccaucacagauuccgggauuaagaaaauccugaacaaucaucucaagacguucauugacgagagcggaaagaucaacuuugaacccgccuucaaucaagauggcaucgaccugcuuaacaaaaauauucagcagcugaacgaggggaagaaucaccaacccaucuauaaagugcggauguacacccacaacacaauguuuucugucggagaugaaggcaacaaguccaccaaauaugugauuccugagagcgggacaaaucucuucuucaacguuuacugggacgaagagaauaacaagcgcaauuuugagaccgugccgcugaacagagucaucgcuuuccagaagcagacgucucauauuccccggaaagaucgcaccgacgugccuaucgauaauacacugggcagauuucuuuucacccugucccccgacgaucucguguaucugccuacagacgaagagagcgaaucuuuuaccacauucgagauugacucccucaacagcaagcaggucgccaauaucuacaaauuuguugauggauccggcaccacggggaacuucgugcccgcggaggcugcccgggugaucgccaauauuaaggacaaaaaggucagaagcaacuuuugcaagcgcaauaaccugucugauaaacaacuuaucaagaaugaguucggacugggcagcccucagcucaaaaaccagaacucccuggacgggcggcagauuaagucuaucuguuggaaacuggaaauuaauagacuuggaaagaucaucaaggugauuaaauga

SEQ ID NO: 4578 - RNA, 4515 nt, Artificial Sequence
  Cas9 variant
augaagaaagugcugggccucgacaucgggaccaacagcgucggaugggccguugugaaucagaacgauaagggcgaguuccuguccauugagaaaaucgggucuagaauuauccccaugagccaagacgugauggauaaguuuggagcuggccagacagaauccucuacggcccagcggacccaguaccgcggggucagacggcuucgcgaaagaagccugcuccggcgcgagagacugcaccgggugcuucauauucugcacuuccucccucaacauuaugacgcggcuaucggauggaauaaaaaggaaaacaagacauacggcaaauuucugccgggcguugaggugaauauccccugggucgccaccgaucaggggcaccaguucauuuuuauggacuccuaugccgagaugcugaaggaucucaaacagcaucaaccucaccuguucgaaaagucuagcacacccgugccucuugacuggaccaucuacuaucugcgcaaaaaggcucucacacaggccauuuccaaggaggaacuggcuuggauccuucugaacuuuaaucagaaaagaggauacuaucagcuccggggcgaggagguugaagauaacaccaagcgcgaggaguucuacgcccugaaaguggucaagguggaacuggacaaagauaauacgagcgcgaagaccugguacaaagugcaccucgaaaacggguuuauuuaucccugcccuucugacacaccgaucgauuccugggucggaaugguuaaggacuucauugugaccacaacccuggagaaggacggcagcgagaaaagaacggccgauggggaaaucaagcggucuuuucgcgcucccaaagaggacgauuggacacuucugaagaaaaagaccgaauccgagcucgaaaagagcggaaaacaagugggcgccuucaucuacgacacacugcuuucuaauccugaucagaagauuaucggcgggcugauuaaaaccaucgagagaaaguauuacaaaaaggagcucgaacagauucuggagacccaacagaaguuuaucgcugaacuguccgacaaaaagcuguuccaggccugugcggaggaacucuauccccuuaacgauagccaucgggagaaucugcucgagagagacuucaaacaccuguuuguccaggauaucauuuucuaccaucgcccucuuaagaccaaaaagucccugaucucuaacugcacguaugaauaccggaccuuuuacaagaauggagagaaacaaauuagccccaucaaguguauugccaaauccaacccccucuuccaggaauuuagaguguggcaguucguucagaaccugcgcauccugcaacggcagagaagcgagggcgacucuaucaaguauaauguggaugucacagcugaguuucucaaagacgaaaacgacauugccaaucuguucaccuggcuuaacgagcgcaaggugaucaaacaggaucagcugcucaaguccuacuuuaagcugaaaguuaauaaggaaacaaaagagcuggacuaucgguggaacuacguggaugacaagaauaaagaauauccuugcaacgcuaccagaacgcacauucuuagcuuccucgagaaguguaaggaggaaaaacgcaucgaggaugaccgguuugucuacucucuguggcaucugcucuauagcguggucgaacccauugagcugagaggggcccuugccaaguucgcugaacgcgagcaucugcacccuuccuuuguggauguuuucgcgcaauucccgccccucgagaaagaauacggaucuuacagcgagaaggccaucaaacggcugcugccucuuaugagaaugggcgacuauuggcacgaagauaagauugacgugaagacaaaacagcggauccagcgcaucauugauggggaggcugacgaugacaucacccacagaucccgggaaaaggucgagaaucucagaagcauuaccgacuuuaaaggacugccgcuguggaaggccggcuacgugguuuauaaccgccauucugaguccggcgaacucacaaaauggaagacaccccacgagcugagcaauuacauccagaacgaguucaagcaauauucucuucggaauccuauuguggaacagaucguccuggagacacucagaguggugcacgaucuguggguuaaacauggggacuuuuccgaaauccaccuggagcuuggacgcgauauuaagaacagcuccgacaaaagaaagcggauggccgaacgccagcaagagaaugaaaacucuagacagcggguccucgagaugcugaucgaucugaaaaaggaggcugccuucgcggaccucaaccccuacagcccuucccagcaggaaaaacugcgcauuguggaggauggcgugcuuagaucuaauaucgaaauucccaaggacaucgagaagaucacgaaaagcgcuaagccgaccucccgggaacugacaaaauaucgccucuggcuggaucaaaaguacagaagcccuuacaccgggcagcccauuucucuggcccagcuuuuuacauccaaauaugagaucgagcaugucauuccucaggccaaguacuucgacgauagcuuuaccaacaaggugaucugcgaaucugagguuaauaaagaaaagggauccaugcucgcucacgaguucauucugaaaaacggcgggagcacggugaaugucggcggacggcaagugcagguucugaagaacgacgccuauguggaacucaucaaucgccuguacggcaaaaacaaucccgucaaggcuaagaaacuucuggccgaggauaucgacgaggugguuggggacuuuucugaaagacagcucaacgauacccgguauauuagcagagugguccagaagcugcuguccaauaucgugcgcgaggaagacgagcaagagagcacaucuaaacacgugauuggauguuccggccaggucaccacagcgcuuaagaaagauugggggcugaacgacaucuggaauaagauuauccagccucgguucgaaagacucaacgagaugaccgccacggaagauuacggaguuuggcaaagccccaaucauuuucagauucgcgugccggaggaaauccagaagggcuucaccaaaaagcggaucgaccacagacaucacgcuauggaugcccuggugauugcuugcgccacacgcucccauaucaacuauauuucuaaccggagcgggcaggacagaaaugcgaaauuugagacaacccgcaccgaucuccgguccaagcuguguuacaaagagaacucuagcggcaauaacuacaauuauaucuucaacaagccuugggacacauucacgcaagaugcccacagagcucuugaaaauauugucgugucccacaagcagaaccugcggguucucaccaaaacaaauaacuacacccaguuuaucaauaaggacggcaaaaaggaccugcagaaacaagugaagggagaucauuucgccguccgcaaacccaugcaccaggagacaaucuaugggagagugucuauucggagcaucaaggaaguugcucugaagaaagcccuugagaacuggaagcagauuguggaccgcacccugaaagauaagaucagagaacucauuggagccuacggcaaauaugacgcucagacgauccugaaguacuuuaaggaucgggacuauaaauucaauaaccucaagaucaauagagucgagguguacgaguacgaucauaacugcgcggccguucgcaaauccauuggggacgaucugacaaucaagcaaauugaacggaucaccgacgagagcauuagaaaaauccuuaugaaccaccugucuaauuaugaugacaaccucaaggaggcuuuuucccccgaaggacugauggaaaugaauaagaacauuaaagagcugaauggcgggaagaaccaucagccuaucuacaaagugcgccuuuucgaggaucugggcagcaaguuuccgcucggagucucucacaauaaccccgacaaauaugccaucgccgcuaagggcaccaaucuguucuuugggauuuacgaagaccaggagggaaagcggauguucgauuccaucccucucaacauugugaucgacagacugaaagaaaagaaaagccccgugccugagacauauaaugagucuaaacuuaaguuucaccugucccccaacgaucuggucuacguuccuaccgacgaggaacagaagcaacccgaacucguggauguggaccaucugagcgaugagcagaaaggccgcgucuauaaggccguguccuucacagggaaucgggcguucuuuguuaaccacagagugagcaaggucauucaugacuacguggaguucggaacgaaaaauaagaucgaaaacgaugacgauaaacgcucucuuaagcacaucuguuggaaacugaagguuaauagacucggcgagauuaccgacgugaagcgguga

SEQ ID NO: 4579 - RNA, 4515 nt, Artificial Sequence
  Cas9 variant
augaagaacaucgugggccuggaccucgggaccaauagcauuggaugggccgucguuaacggcuccgugaaugaugacgggucugagcagcuggugaaaauccaagcuagcggauccagaauuauccccauggaugccgcgaugauuggcgacuucaacaagggaaauucuaucagccagacagcugaacggacgcgccuuagagggguccggcgccuguccgagagauaccuccugcggcgcgaaagacuucaccggauccuggauauucucggcuuucugccuuuccauuuugcccaggaccuggaucgccacggcaaaaucgugaaggggaaagagccgaagcucgccuggagaaagaacgaagcuggacaguucgaguuuauuuuccaagacucuuuuaaagagaugcuggaagauuucaaacuuaauuaucccaaccugaucaccgacgauaaaaagguuccuuacgacuggacaauuuauuaccuccggaaaaagggccugaccagcaagaucuccaaagaggaacuugccuggauucugcucaauuuuaaccagaagcgcggguauuaccagcugagaggagaggaggaagaggaaaauaaagauaagcugguggaguucuaugcucucaaagucguggccguugaagacagcggcgagaagaaagggaaggacaucugguacaacgugcaucuggagaauggaugggucuaccggcgcacaucuaacaugucccuugauugggugggcaagaccaaagaauuuaucgugacaaccgaccuggagaaggauggcacgcccaaaaaggacaaagaagggaaugucaagcggagcuucagagcgccuaaggaggaugacuggucucucguuaaaaagaaaaccgaagccgauauugaccagacacacaagaccgugggagcuuauaucuacgauacacugcuuggcaaccccucccaaaagauuagagggcgccuggugcggaccaucgagagaaaguauuacaaggaggaacucaaacugauucuggagaagcagaaagaauuucaucucgagcugcaggaccgcgcccuuuaugcugccugcaucgaggaacuguacccuaucaacgaggcgcaccggaauaacgucggaaauagagauuucacguaucucuuccuggaagacauucuguuuuaccagcgcccgcuuaagagcaaaaagucucucaucgacaacugucccuacgaggaaaaucaaggccuggauaaggagacaggggagauuaaauccuucccugugaagugcaucgccaaaagccacccccuguuucaggaguuccggcucuggcaguuuauuaucaaccugagaaucuaucgcaaggaccuugcucaagauguugacgugaccaaugaacugcucaaaacagaagaggauuacgucgcccuguucgacuggcugaacggaaagaaagaaauugaucagaaggcuuuucuuaaguauccuguguucggccucaaaaaggagaucgagaauuaccgguggaacuauguucaggacaaacccuacccguguaaugaaaccagaucccugaugcuggcccgccucgagaagugcgauauuucuaucgaauuucugaccaaagagaacgaagaggcccuuuggcauauucuguauagcguggaggacaagaaugaaaucgucaaggcucuccagaaauucgcggauaagcacgaccugaacgccuccuuuguggaugucuuccaaaaauuuccucccuucaagaaagaguacggcagcuacucugcuaaggccauuaagaaacugcuuccucucaugcggauggggaaguauugguccgaaaauagcaucgacaaaggaacaagagagcggaucgacaagauuaucacgggcgaauacgaugagaaaauugagaaccgcgugagagaaaaggccauccaucuggcugacguuucugauuucaaggggcugccccucuggcugguguguuauauugucuacggacggcacagcgaggccaaagaaaucauccaguggaagucccccgcggacauugauucuuaucuucgcagcuuuaaacagcacucccugagaaacccuaucguggagcagauuaucauugagacccuccggguugugagagacaucuggaagcaagucggcaauaucgaugaaauucauguggagcuggggcgcgaaaugaaaaacccggcugacaagagaaagaagaugacacagcagaugagcgagaaugaaaacaccaaucugcggaucaaguaccuucucacagaguuccugaaccccgaguaugaaguggagaauguucgcccuuacucucccucccagcaagauauucugagaaucuacgaagagggcguccucaacagcgugucugaccugccugaagagauuuccgauauccuuaaaaaguuuaccgagacggaccugaaaaagcggcccagccgcuccgaagugcucagauauaaacuguggcuggagcagaaguaccggucuccguauacaggagaagucaucccucuuggcaaacucuucacccccgccuacgagauugaacacgugaucccucagagcuauuacuuugaugacuccuucucuaauaaaguuauuugcgaggccgaggugaacaagcugaaaagcaaucugcucgggcaugaauuuaucgucaagcaccauggagagauuguggaacugcccuucggcaaaaagguucgcaucuuuaccguggacgaguaugagcaguucgucaaggauaacuacuccagaacacggagcaaaaugaagaaacuucugauggacgauauuccugaagaguuugugacccgccaacucaaugacucuagauacaucuccaagguugugaaaagccugcugucuaacaucguccgggaaaagggggaggaagaggcuauuuccaagaaugugauccccuguacaggaggcgugacggauagacuuaaaaaggacugggggauuaacgaggucuggaacaaaaucauucugccgcgcuuccagcggcucaaugaacugaccggcacaaacaaguuuaccaccaaaaauguuggaauccaggagaucccuacaaugccccucgaacugcaaaagggcuucaacaagaaaagaauugaucaccgccaccaugccauggacgcuaucauuaucgccugcgcgaaucggaacauuaucaauuaucuuaacaauaagagcgccacggcuaaagccgagcugucuagauacgaucuccagaagaugcugugugacaaagcuaagaccgauaacaaugggaacuauaaaugggugauccgcaagcccugggccagcuucacacaggacaccuaccuggcgcuugaaaauauuaucguguccuuuaagcagaaccugcgggucauuaauaaagccacaaacagauuccuccacuauaacgaggagggaaagaaaaucuuugugaagcaaggcaaaggggacaauugggcuauucgcaagagcaugcauaaggauaccguuuucggagaagugaaccugcggagaaucaaaacggucgcccucaaugaggcuaugaagaacccucagucuauugugguuaaagacuuuaagcggaaacugcuugaacuguggaaucucggcuucgaugccaagcgcaucaagaaauacuuugaggacaacagagaaacaugguccgauaucaaucugagcaagauugagguguauuacuucuccaaagacaccaaggaucgguuuuucgccacacgcaaaccgcuggacaccucuuuugauagaaagaagaucgagaacaauauuaccgacacagggauccagaaaauucuucugcggcaccucgaacugaaggauaacaaucccgacaucgcuuucagcccugauggcaucgacgagaugaacagaaauauuauccagcucaacaauggaaaauaccaccaacccauuaucaagauucgcugguaugaacaggcggacaaauucgccgucggccagacggggaacaaguccucuaaauuuguggaggcugccaagggaaccaaucuguucuuugccguuuacgagagcaacauccuugauaagaaaacaaacaccaucauuaagaaacggaauuaugcuacaaucccucugaacguggccauugaaagacagaagcaaggccugcccgucgcgccugaggacgaaaaugggaacgaucccaucuucgugcucuccccgaaugaccugguguaccuuccuaccgaugacgagcuggcuaacggaauuaucgcccagccccucgaucgcggccggauuuauaaaauggucucuagcuccggggaacagugcuuuuucaucaagcauaucguugccaaugugcugguggacaaguuugaguucagcccucucaacaaaauggagagagcucugacgggcgaaaugauuaagaugaucuguauucccaucaaagucgaucgccuuggaaaugugcuggagucuuccagcucuuacaagaaauga

SEQ ID NO: 4580 - RNA, 4515 nt, Artificial Sequence
  Cas9 variant
augaagaacaucgugggccuggaccucgggaccaauagcauuggaugggccgucguuaacggcuccgugaaugaugacgggucugagcagcuggugaaaauccaagcuagcggauccagaauuauccccauggaugccgcgaugauuggcgacuucaacaagggaaauucuaucagccagacagcugaacggacgcgccuuagaggaguccggcgccuguccgagagauaccuccugcggcgcgaaagacuucaccggauccuggauauucucggcuuucugccuuuccauuuugcccaggaccuggaucgccacggcaaaaucgugaaggggaaagagccgaagcucgccuggagaaagaacgaagcuggacaguucgaguuuauuuuccaagacucuuuuaaagagaugcuggaagauuucaaacuuaaucaucccaaccugaucaccgacgauaaaaagguuccuuaugacuggacaauuuacuaucuccggaaaaagggccugaccagcaagaucuccaaagaggaacuugccuggauucugcucaauuuuaaccagaagcgcggguacuaucagcugagaggagaggaggaagaggaaaauaaaaacaagcugguggaguucuacgcucucaaagucguggccguugaagauagcggcgagaagaaagggaaggacaucugguauaaugugcaccuggagaacggaugggucuaccggcgcacaucuaauaugccccuugacugggugggcaagaccaaagaauuuaucgugacaaccgaucuggagaaggacggcacgccuaaaaaggauaaagaagggaacgucaagagauccuuccgggcgcccaaggaggacgauuggagccuccugaaaaagaaaaccgaagccgacauugaucagacacauaagaccguuggaguguacaucuaugacacacuucugggcaacccuucucaaaagauuagagggcgccucgugcggaccaucgagagaaaguacuauaaggaggaacugaaacagauucuggagaagcagaaagaauuucaccucgagcugcaggaucgcgcucuuuacgccgcuugcaucgaggaacuguauccgaucaaugaggcccaccggaacaaugucggaaacagagacuucacguaccucuuccuggaagauauucuguuuuaucaacgcccccuuaaguccaaaaagagccucaucgacaauuguccuuacgaggaaaaccagggccuggacaaggagacaggggagauuaaaucuuuccccgugaagugcaucgcgaaaucccauccucuguuucaggaguuccggcucuggcaauuuauuguuaaucugagaaucuaccgcaaggaucuugcccaggacguggaugucaccaacgaacugcucaaaacagaagaggacuauguggcucuguucgauuggcugaauggaaagaaagaaaucgaccagaaggccuuucuuaaguaccccguuuucggccucaaaaaggagauugagaacuaucgguggaauuacgugcaggauaaaccguauccuuguaacgaaaccagaagccugaugcuggcucgccucgagaagugcgacaucuccauugaauuucugaccaaagagaaugaagaggcccuuuggcacauccuguacucugucgaggauaagaacgaaauugugaaggcccuccaaaaauucgcugacaagcaugaucugaaugcgagcuuugucgacguguuccagaaauuucccccuuucaagaaagaguauggcuccuacagcgccaaggcuaucaagaaacugcuuccccucaugcggauggggaaguacuggucugaaaacuccauugauaaaggaacaagagagcggaucgacaagaucauuacgggcgaauaugacgagaaaaucgagaaccgcguuagagaaaaggccauucaccuggccgaugugagcgacuucaaggggcugccccucuggcuggucuguuacaucguguauggacggcacucugaggcuaaagaaauuacccaguggaaaagcccugccgauaucgacuccuaccuuagaucuuuuaaacagcauagccugcgcaauccgaucguugagcaaauuaucauugagacacuccggguggucagagauaucuggaaacaggugggcaacauugacgaaauccacguggagcuggggcgcgaaaugaaaaaucccgcggauaagagaaagaagaugacccagcagauguccgagaacgaaaauacaaaccugcggaucaaguaucuucucaccgaguuccugaauccugaguacgaaguugagaacguccgccccuauagcccuucucaacaggacauucugagaaucuacgaagagggcgugcucaauuccgugagcgaucugcccgaagagauuucugacauccuuaaaaaguuuacggagacagaucugaaaaagcggccgucccgcagcgaaauucucagauacaaacuguggcuggagcagaaguaucgguccccuuacaccggagaagucaucccccuuggcaaacucuucaccccugcuuaugagaucgaacaugugauuccccagucuugcuacuuugacgauagcuucuccaacaaaguuaucugugaggccgaggugaauaagcugaaaucuaaccugcucgggcacgaauuuauugucaagcaucacggagagaucguggaacugccuuucggcaaaaagguucgcauuuuuacaguggacgaguaugagcaauucgucaaggacaauuacagcagaacccgguccaaaaugaagaaacuucugauggaugacauccccgaagaguuugugacacgccagcucaacgauagcagauauauuucuaagguugugaaaucccugcugagcaauaucguccgggaaaagggggaggaagaggccaucucuaagaacgugauuccgugcacgggaggcgugaccgacagacuuaaaaaggauugggggaucaacgaggucuggaauaaaauuauccugccucgcuuccagcggcucaacgaacugacaggcaccaauaaguuuacaaccaaaaacguugggauucaagagauccccacgaugccccucgaacugcagaagggcuucaauaagaaaagaaucgaccaccgccaucacgcuauggaugccauuaucauugcuugugccaaccggaauaucauuaacuaccuuaauaacgaguccgcgaccgccaaggcugaacugagcagauacgaccuccagaaaaugcugugcgauaaggccaaaacagacaauaacgggaauuauaagugggugauccgcaaaccuugggcuucuuucacccaggauacauaccuggcccuugagaacaucauugugagcuuuaagcaaaaucugcgggucaucaacaaggcgaccaacagauuccuccauuauaaugaggaaggaaagaagauuuuugugaaacagggcaagggggacaacugggccauccgcaaauccaugcacaaggacacgguuuucggagaggugaaucugcggagaauuaagacagucgcucucaacgaagccaugaaaaauccgcagagcaucgugguuaaggauuuuaaacggaagcugcuugagcuguggaaccucggcuucgacgcuaaacgcauuaagaaguacuuugaagauaauagagagaccuggucugacaucaaccuguccaaaaucgagguguauuacuucagcaaggauacaaaagaccgguuuuucgccacccgcaagccccuggauaccuccuuugacagaaagaagauugaaaauaacaucacagauacggggauucagaagauccuucugcggcaccucgagcugaaagacaauaacccugauauugccuucucucccgacggcaucgaugaaaugaauagaaacaucauucaacucaauaacggaaaguaucaucagccuaucauuaaaauccgcugguacgagcaggcugacaaguucgcggucggccagaccgggaauaaauuuagcaaguucguggaggccgcuaaaggaacaaaccuguuuuucgccguuuacgaauccaacauucuugacaagaagaccaauacaaucaucaaaaagcggaacuaugccaccauuccccugaauguggcuaucgagagacaaaaacagggccugccugucgcccccgaagaugagaacgggaaugacccgauuuuugugcucucuccuaacgaucugguguaccuucccacggacgaugaacuggcgaauggaaucauugcucagccucucgaccgcggccggaucuauaagauggucagcuguacagggaacgagggccacuucauucccgccagaaucgccaauccgauccugcaaaccauugagcucggauccaacaauaaagcucagaaggccuggaccgaugaaaugaucaaggagauuugcaugccuaucaaaguugaccgccugggcaacgugcuugaaucuagcuccagcuacaagaaauga

SEQ ID NO: 4581 - RNA, 4521 nt, Artificial Sequence
  Cas9 variant
augaagaccauccugggccucgaccuggggcccaacagcauuggaugggccaaaguggaggucgaugacgaaggcaauuaccuuagaaacaucaagcuggggucccggauuaucccuaugacacaggauaugcucggagacuucgauaaaggcguuaaggugucucaaacggcuauucgcaccgacuuuagagggaaucggcgccugaucgagagacaccuucugcggcgcgaaagacuccaucgggugcugcacgcccugaaauuccucccgaagcauuaugaggaugcgaucggaugggaccgcaacgaacccgcuacauacggcaaguuugucaauaacagcgagccuaaacuggccugggagagacaggaagauggcuccaugcgguuccuuuuuauggagucuuucaaugaaaugguggccgacuuugcucagaaccagcccagccugguuuccgaugggaagaaaauuccucucgacuggaccaucuauuaccugcgcaagaaagcccuuacaagacccauuaagaaggaggagcuggcuuggauccuccugaauuucaaccaaaaacggggauauuaccagcugcgcggcgaagaggaagaggauaaucucaccaagagaaaagaauauuacaagcugaaaguggucgggguggaggccgacggagcgccuaagggcgggaaaacaugguacaacauucaccuugagaauggauggaccgcccggugccagucuaagaucccgcuggacgauuggguuggcaaggugaaagaauauauugucacgaccgaguacgaagacgauggcaagacacccaaaugugacaaggaggggaaagugaagcgcagcuuuaaguccccugaaaaagaugacuggcagcucaucaagacccgcacagagaaauucaucgaugacagcaacaagaccgugggagcuuuuauuuaugauuaccugcuugagaaacccuucgacaagauccggggcaaguauauuagaacgaucgaacgcaaauacuauaagaaugagcugcgggaaauucucagagagcaaacaaaauaccaugaagggcugcacucucuggaggcccucaagaucugcgcugaggaacuguacaaaaacaaccagcagcaccaggaguaucuucugaagaaggauaugaccuuucuccugcuuaaugaccugaucuucuaccaacgcccucucaaauccaagaaaagccugauugccgacugucccuaugaagucuacaaguaugaugacaaacugacaggaaagaaaggccagaagaagaucaaaugcauugcgaagucuaacccguacuaucaggaguuccggcucuggcaauuuaucgccaaucugagacuuuucuccguuaccgaugggaaagaggugaccgcugaauaccugaagacagaggaagacuacgugcgccucuuuagcuuccugaacgaucggaaagacauuaagcaggagacguuucugagaucuuuccuuaagcucaaaaaggaauccaucggaagcgagaaaaucuauccuauucgcuggaauuacaucgaggaugccaacaaguccuaucccuguaaugcuacccggcaugaacugcugcucgccuuugacagagccgauauuccucgggagcugcuugacgucgaagagagagaauacagacuguggcaccuccuguauucuaucgaggcuaaagaggaaacagagagcgcgcugcggaaacuuaaggccaacaaggcuuucggcgaucucaauauugacgaugccuuugugaacuccuuccugaagaucaaacccuuugaaaaggaguacggcgccuauagcgaaaaagcuauuaagaagcugcucgccguuaugagacgcgggucucuguggaaagaggcggacaucugcgaggcuaccaagcagaauaucgccaaaauucuucagaacgacaucgaugaaaagcugaaaaagaaaauugaggccgcuguguccagcuucaauaagcucucugacuuucaaggacugcccacauggcuggccuguuacgucguguacggccggcauagcgaagcugcccagauccagugcuggcaguccccugaggaucuuaagaccuauauuaacaaauucaagcaacacucucucagaaauccgaucguugagcagugucugcuggaaacgcuccgcacaguguacgacaucuggaaagaugcggggcagauugacgagauccacauugaacugggaagaaacaugaaaagcaccgccgagcagcgggcucgcaagaccaaggauauccuuagaaacgaaaauacaaaccugcggauuaagaaucuccuggucgagcugaaaaacgacgauaagaucgagaaugugcgccccuauuccccuagccaacaggaaauccuuagaauuuacgaggaaggcgcccuccaggagcugucuaaagaagacgagauguucgaggauaucuccaagauuagcaaaauggcucagcccucuccuaccgaacugucccgguauaagcucuggcuggagcaaaaguaccgcagccccuauacagggagagucaucccgcuuuccaaacuguuuacgaccgccuaccagauugaacauaucaucccucagucucgguacuucgacgauagcuuuaacaauaaggugauuugcgaguccgaaguuaacucucucaaagacaauaugcugggcuaugaguucaucaaggaguguggaggccgcauugugcacugcacacugcuuggggacgucaaaaucuuuaccaaggaagaguacaaggauuucgugacaaaacauuauauugacaacaccuacaagagagauaaacugcuccuggaagacaucccccaagaguuuagcgcgcggcagcucaaugauuccagauauauuagcaagaugguucagacggugcugucuaacaucguccgcgccgagaaugaacaggaggcuaccuccaaauucguggugagcugcaacggagccaucacaaaucggcuuaagaaggacuggggccugaacgauguuuggucuuccauugucuguccuagauuuaaacgccucaacgaaaucaccaagacaaaugcuuucgggcacugggaggacaaagccggaaagcauguguuucaaaccacggugccccuggaacugcagcggggcuucagcaaaaagagaauugaucaccgccaccaugccauggacgcucuugucaucgcgugcgccucucggaacauugugaauuaccugaacaaugagagcgcuaacuccccugagaaaagagaagaucuccgcaagaagcugugugacgagaaacggaagaucagaaaacccuggaagacauuuacccaggacgcccgggaagcccucagcgauguuguggucucuuucaaaaauuaugugcgcguuaucaacaaggcuacaaauuacuacgagcacuauuccagcuccgggaacaaggugaugauuucucagaaaggcaaugacaugugggccaucagaaagccgcugcauaaagaaagcgucuucggacgggugaaccuuugccgcaagguuauugugucccugaaaaaggcgcucgagaauaucccugcuauuugugauaagacccugagagacuacaucaacgcccuggucgagaaacacuuuaauacccggcaacuucuggcccacuucaagucuaucaacuauagacucaaccgccagugcguggaaaaaguggaggucuggcaguuuagcgaugaaaagauugagaugguugcucggagaaaaucccuggacacaucuuucgaugacaagcagaucagcuccauuacggauaccggcauccaaaagauucuccugaauuaccuucagacaaaagacgggaacgccgaaaucgcguuuacccccgagggaauugaggaaaugaauaagaacaucagccuguauaaugauggcaaagcucaucagcccauccugaaggugcgcguggccacaccuaaagggaugaaguacccggucggacaaaccggcaacaaagccacgaaguucgugguugcugagaaggggacaaaucucuauuuugccauuuacgaaaacgagcugggcgugcggucuuacgacaccaucccccuuaauauugucguggagagacugaaagaaggacucuccccuguuccccaggcuaacgaggccgauaucccucugaaguucuaucucagccccaaugaccugguguacgucccuaccaaagaaaacgaggacgaacuuugucgcgaucggauuuauaaguuuguggacucuuccggcacaaccgcgaauuucguuccccacacaagcgccaacacgaucuacaauguggauaaagaguaugcugagaagugcuguaacggggccgucuuucugaaugaauacggacugggcucuccgcaguccaagaaccagagagcucucaccggggagaugaucaaagaaauuugcuggaagcugaaaguggaccgccuuggaaacaucauuaaggugaucaaauga

SEQ ID NO: 4582 - RNA, 4530 nt, Artificial Sequence
  Cas9 variant
augaagaacaucgugggccuggaccucgggaccaauagcauuggaugggccgucguuaacggcuccgugaaugaugacgggucugagcagcuggugaaaauccaagcuagcggauccagaauuauccccauggaugccgcgaugauuggcgacuucaacaagggaaauucuaucagccagacagcugaacggacgcgccuuagagggguccggcgccuguccgagagauaccuccugcggcgcgaaagacuucaccggauccuggauauucucggcuuucugccuuuccauuuugcccaggaccuggaucgccacggcaaaaucgugaaggggaaagagccgaagcucgccuggagaaagaacgaagcuggacaguucgaguuuauuuuccaagacucuuuuaaagagaugcuggaagauuucaaacuuaaucaucccaaccugaucaccgacgauaaaaagguuccuuaugacuggacaauuuacuaucuccggaaaaagggccugaccagcaagaucuccaaagaggaacuugccuggauucugcucaauuuuaaccagaagcgcggguacuaucagcugagaggagaggaggaaaagaagaaugauaacgugaugaucaucaauagcaaagucauugacgugguuaaggcugagaaagacaagaaguacgaaaaauauugguacaacgugcugcucgagaauggccugcuuuaccgggccgcguucuauaacgauaucucuuuuuggaaggggcacacaaaagaguucguccugaagaccauuaaacucaaguccggaggcacaaagcaggaacugagcuuucuucccucuuucgacgagaucgagaaaauggaaaagaaacaaaaggauaaaauguacuucaagauuaagcugaaaaccgaagccgacaucgaucaggcucauaagacggugggcaccuauaucuacgacacacuccuggggaacccuucccagaaaauucgcggaagacuggugcggaccaucgagagaaaguauuacaaagaggaacucaagcugauucuugauaagcagaaagaguuucaccccgaacugcaagaccgcgcccucuaugcugccugcaucgaggaacuguacccuauuaaugaggcgcaccggaacaaugucggcaacagagauuucacauaccuuuuucuggaagacauccucuucuaucagcgcccgcuuaagagcaaaaagucucugaucgauaauugucccuacgaggagaaccaggggcucgacaaagaaaccggagagauuaaguccuuuccuguuaaaugcaucgccaagagccauccccuguuccaagaauuucggcuuuggcaguucauugugaaucugagaaucuaucgcaaggaccucgcucaggauguggacgucacgaacgagcugcugaaaacagaggaagauuacguggcccuuuuugacuggcucaauggcaagaaagagauugaucagaaggcuuuccugaaauauccuguuuuugggcugaagaaggaaaucgagaacuaccgguggaauuaugugcaagacaaacccuacccguguaacgaaaccagacuccugaugcuugcccgccuggagaagugcgauauuuccaucgaguuccucacaaaagaaaaugaggaagcccuguggcacauccuguacucugucgaggacaagaacgaaauugugaaagcucugcagaaguuugcggauaagcaugaccucaaugccagcuucguugauguguuccggaaauuuccucccuucaagaaagaguauggauccuacagcgcuaaggccaucaaaaagcugcugccucucaugagaaugggcaaguauuggucugaggacuccauugauaaaggcacccgcaagcggauggacaaaaucauuaccggggaauacgacgagaagaucgaaaacagaguccgggagaaagugauccaccuggccgaugucagcgacuuucgcggacuuccccuguggcucguguguuauauuguuuacggcagacacucugaagcuaaggagaucacacaguggaaaagccccgccgauauugacuccuaucugaagucuuucaagcagcauagccugcggaacccuaucguggagcaaauuaucaucgaaacgcuuagagucgugcgcgauauuuggaaacagguugggaauaucgacgagauucacguggaacucggacgggagaugaagaacccggcggauaaaagaaagaaaaugacccagcagauguccgagaaugaaaacacaaaucugcgcaucaaguaccugcucaccgaguuucugaaccccgaauacgaggucgaaaaugugagaccuuauagccccucucaacaggacauucuucggaucuacgaggagggcgugcugaacuccguuagcgaucucccugaagagaucucugacauucugaagaaauucacagaaaccgaucugaagaaacgccccuccagaagcgagauccuucgguauaagcucuggcuggaacagaaauaccgcuccccguauacgggggaggucauuccucugggcaagcucuuuacacccgcuuacgagaucgaacaugugauuccucagucuugcuauuucgacgauagcuuuuccaauaaggugaucugugaggccgaagucaacaaacugaagucuaaucuucugggacacgaguucauugugaaacaucacggcgaaaucguugagcuccccuuugggaagaaagugagaaucuucaccgucgacgaguacgaacaauuugugaaggacaacuacagccggacccgcggaaagaugaaaaagcugcugauggaugacauuccugaggaguucguugccagacagcuuaaugauucccgguauaucagcaaaguggucaagucucugcucuccaacauugugcgcgaaaaaggcgaggaagaggcuaucagcaagaauguuauucccugcacagggggagugaccgacagacugaagaaagauuggggcaucaacgaagucuggaacaagaucauucucccgcgguuccagagacugaaugagcuuacagggacgaacaaauuuaccacaaagaaugugggcauccaagaaauuccuaccaugccccuggagcuccagaaaggauucaacaagaaacgcaucgaccaccggcaucacgccauggaugcuauuaucaucgccugugcgaauagaaacauuaucaauuaccugaacaaugagucugccacagcuaaggccgaacugucccgcuaugaccuucagaagcugcucugcgauaaagcuaagaccgacaacaauggcaacuacaaaugggugauucggaagcccugggccagcuuuacgcaggauaccuaucuggcgcucgagaauaucauugucucuuucaaacaaaaccugagaguuaucaauaaggccacaaaccgcuuucuucauuacaacgaagaggggaagaaaauuuucgugaagcagggaaaaggcgacaauugggcuaucagaaagagcaugcacaaagacaccguguuuggggaagucaaccugcggcgcaucaagacaguggcccucaaugaggcuaugaagaacccucaguccauuguugugaaagauuucaagcggaaacugcuggagcuuuggaaucugggauuugacgccaagagaaucaaaaaguauuucgaagauaaccgggagaccuggagcgacauuaaucucucuaagaucgaagucuacuacuuuuccaaagauacgaaggaccgcuucuucgccacaagaaaaccgcuggauaccagcuuugaccggaagaaaauugagaacaauaucacagauaccggcauccagaagauucuccugcgccaccuugaacugaaagacaacaaucccgauaucgcuuucuccccugacgggauugaugagaugaacagaaauaucauucaacugaacaauggcaaguaucaucagcccaucaucaagauucggugguacgagcaggcggacaaauuugccgugggacagaccggcaacaaguucucuaaauuuguugaagcugccaaggggacaaaucucuucuuugccguguaugagagcaacauccuggacaaaaagacgaacaccauuaucaagaaaagaaauuacgcuacaauuccucuuaacgucgccaucgaacgccaaaagcagggacugcccguggcgccugaggaugagaauggcaacgaccccauuuucguucucuccccgaaugaucugguguaucucccuaccgacgaugaacuggcuaacgggaucaucgcccagccccuugaccggggaagaauuuacaaaauggucucuuguacaggcaaugaggggcacuuuaucccugcccgcauugcuaaccccauccugcaaaccauugaacugggcagcaauaacaaggcccagaaagcguggacggaugagaugaucaaggaaaucugcaugccgauuaagguggaccggcucggaaaugugcuggaguccucuagcuccuauaaaaaguga

SEQ ID NO: 4583 - RNA, 4530 nt, Artificial Sequence
  Cas9 variant
augaagagaauccugggccucgaccuggggaccaacagcauuggauggucccuuaucgagcacgauuucaaaaauaagcagggccagauugaagggcugggagugcggaucauucccaugucucaggagauccucggcaaauuugacgccgggcagagcaucucccagacagcugaucgcacgaaguacagaggaguccggcgccuguaucaaagagacaaccuucggcgcgaaagacugcaucggguucucaaaauucuggauuuccugccuaagcacuacucugagagcaucgacuuucaggauaaggugggccaguucaaaccgaagcaggaagugaaacucaauuaucgcaagaacgagaaaaauaagcaugaguuugucuucaugaacuccuuuauugaaauggugucugaguucaagaaugcccaacccgaacuguuuuacaacaaaggcaauggggaggagaccaagaucccuuaugacuggacacuuuacuaucugagaaagaaggcgcucacccagcagauuacaaaagaggagcuggcuuggcuuauccugaacuucaaucagaagcggggauacuaccaacuccgcggcgaagauauugacgaggauaaaaacaagaaguauaugcagcugaaaguuaauaaccugaucgacagcggggccaaggugaaaggaaagguccucuacaaugugaucuuugauaacggcuggaaauaugaaaagcagauuguuaacaaggacgagugggaggggagaaccaaagaauuuaucauuacaaccaagacgcugaaaaauggaaacaucaagcggaccuacaaagccguggacuccgagauugauugggcugccaucaaggcuaagacagaacaagacaucaauaaagccaacaagaccgucggcgaguauauuuacgaaagccuucuggauaaucccucucagaaaauccgcggcaagcucgugaaaacaauugagagaaaguucuauaaggaggaauuugagaaacugcuuuccaagcagaucgaacugcagccugaacucuucaacgaaagccuguacaaagcgugcauuaaggagcuguacccccggaaugagaaccaccaaucuaauaacaaaaagcagggguucgaauaucucuucaccgaggacaucaucuuuuaccagagaccucugaaaucccaaaagagcaauauuucuggaugucaguucgaacauaagaucuauaaacagaagaacaaaaagacgggcaaacuugagcugauuaaggagccgaucaagacaauuucccgcagccacccccucuuucaggaguuccggaucuggcaguggcugcaaaaucuuaaaauuuacaacaaggagaaaaucgaaaaugggaagcuggaggaugugaccacacagcuccugccuaacaacgaagccuaugucacccuguuugacuuccucaauaccaaaaaggagcuggagcagaagcaguuuaucgaauacuucguuaaaaagaaacuuauugauaagaaagagaaggaacacuuuagauggaacuucguggaggacaagaaauaucccuuuuccgaaacacgcgcucaauuccugucucggcucgccaaggugaaaggaaucaagaauacggaggauuuccugaacaaaaauacccaggucggcagcaaggagaacuccccuuuuauuaaaagaaucgaacagcuguggcauauuaucuacagcgugucugaccuuaaggaguacgaaaaggcucucgagaaauucgccgaaaagcacaaucuggagaaagauuccuuucugaagaacuucaaaaaguuucccccguucguuagcgacuaugcgucuuacagcaagaaagccaucuccaagcuccugccuauuaugcgcauggggaaauauuggucugagagcgcugugcccacacaagucaaggaacggucccuuagcaucauggagagagugaaaguucugccucucaaggaaggauacucugacaaggaucuggccgaccugcuuucccgcgugagcgaugacgauauucccaaacagcucaucaagucuuuuauuuccuucaaagacaagaauccccugaaaggccugaacaccuaucaggcuaauuaccucgucuauggccggcauagcgagacaggggauauccagcacuggaagaccccugaggacaucgauagauaccugaacaauuuuaagcaacacucccuucgcaacccgauuguggaacaggucgugauggagacgcugcggguugugagagacaucugggaacauuacggaaauaacgagaaagauuucuuuaaggaaauucacgucgagcucggccgggagaugaaaucucccgccgggaagcgcgaaaaacugagccagagaaacacagagaaugaaaacaccaaucaucggaucagagaggugcugaaggaacuuaugaacgacgccuccguugagggaggcgugcgcgauuauucuccuagccagcaagagauucucaagcuguacgaagaggggaucuaucagaaucccaacaccaauuaccugaaagucgacgaagacgagauccucaagauucggaaaaagaacaauccuacacagaaagaaauccagagauauaagcuguggcuugagcaaggcuacauuucccccuauaccggaaaaaucauuccgcugacaaaacucuucacgcacgaguaccagaucgaacauauuaucccucagagccgcuacuaugauaacucucugggcaauaagaucauuugcgaguccgaagugaacgaggacaaagauaauaagaccgcuuacgaguaucugaaaguggaaaaggggagcaucguuuuuggacacaaacuucucaaccuggacgaguacgaagcgcacgucaauaaguauuucaagaaaaacaagacaaaacugaagaaccuccugucugaggauauucccgaaggcuucaucaauagacaacuuaacgacucccgguacauuagcaaacuggugaaggggcuccugucuaauaucgugcgcgagaacggagagcaggaagccaccagcaagaaucugaucccugucacaggcgugguuaccuccaaacuuaagcaggauugggggcugaacgacaaauggaaugagauuaucgcucccagauuuaagcggcucaacaaacugacgaauagcaacgauuucggcuuuugggacaaugauauuaacgccuuccgcauccaggugccugacucucucauuaagggauuuuccaagaaaagaaucgaucaucggcaccaugcccuggacgcucuugucguggccuguaccagccgcaaucacacacacuaucuguccgcgcucaacgcugaaaauaagaacuacucucugagagacaaacugguuaucaagaaugagaacggcgauuacaccaaaacauuccaaauucccuggcagggguuuaccaucgaagccaagaacaaucuugagaaaacgguggucagcuucaagaagaaccugcgggugauuaauaaaacaaacaauaaguuuugguccuauaaagacgagaacggaaaucucaaccugggcaaggaugggaaaccgaagaagaaacuccgcaagcagaccaaaggauacaauugggccaucagaaagccucugcauaaagaaacaguuucuggcauuuauaacaucaaugcucccaagaacaagauugccaccagcgugcggacccuucugacagagaucaaaaaugaaaagcaccucgcuaaaaucacggaccugcgcauuagagagaccauccugcccaaccaucuuaagcacuaccugaauaacaaaggggaagccaacuucuccgaggcguuuucucagggcggaauugaggaucucaauaagaagaucacaacccugaacgaaggcaaaaagcaucaaccuauuuaucgggucaaaaucuucgagguggggagcaaguucuccaucagcgaagacgaaaauucugccaaauccaagaaauacguggaggcugccaagggaacaaaccucuuuuucgcuauuuaucuggaugaagagaauaagaaaagaaacuacgaaaccaucccgcuuaaugaggucauuacgcaccagaagcagguugccggcuuucccaaaagcgaacgccugucugugcagccugacucccaaaaggggacauuccuguuuacccucagccccaacgaucugguguacgucccuaauaacgaggagcuugaaaaucgggaccuguucaaccucggaaaucugaacguggagcagaucucuagaauuuauaaauuuaccgauuccagcgacaagacaugcaauuucauccccuuucagguuuccaagcucaucuucaaccugaaaaagaaagaacagaagaaacuugacguggauuuuauuauccaaaacgaguucggccuggggagcccucagucuaagaaucaaaagagcauugacgaugucaugaucaaagaaaaguguauuaaacugaagaucgaccgccucggcaacauuuccaaagcguga

SEQ ID NO: 4584 - RNA, 4530 nt, Artificial Sequence
  Cas9 variant
augaagaccauccugggccucgaccuggggacaaacagcgugggaugggccgucauuaauuccguuaucaaagagcaggcugaaagaauuuggaucgagauggccggcucucggauuauccccauggaugcggcugugcuuggggacuucgauaagggaaacagcaucucccaaacgucugaacgcaccagacugcggggcgugcgcagacuccgggagcgccagcugcuuagacgggaacgccugcacaaaguccucaauauucugggguuucugccuaaccauuaccucgaguauaucgacuucgagaagcacccgggaaaauuucugagcgaugccgaacccaaacuuccuugggugaaggacgagcagggcaaauacacauuccuguuucaggccgcuuucgaugaaaugcucgccgacuuugcuauucaucaacccucccugguuucuggcgauaagaaaaucccuuaugacuggaccauuuacuaucuuagaaagaaagcccugacagagaugaucagcaaggaggaacucgcguggauucugcugaauuucaaccagaagcggggguacuaucagcuccgcggagaggaagaggaagauaaugccggcaaauccguggaguuuuacgcucugaagguccuuaccguggaggccacagacgaaaagaaggggagagauguuugguacaacgugcaccuggagaauggauggaucuaucggcgcucuagcuccgucccccucgacugggaaggccagaucaaagaguucauugugaccacggaccugaacccugauagcaccccgaaacuugacaaauacggggaagugaagagaucuuuucgggcucccaaggaggaugacuggaugcugaucaaaaagagaacagaggccgauauugcgaauacccauaaaacagucggagccuauaucuacgacacccuccugcaaaagccucagcagaaaauuaucggcaagcugguuaagacgguggaacgcaaacucuaucgggaugagcugucccuuauccugcagaagcaaugcgcuuuccacgccgaacuccaggacagaacacuguacgcucgcuguguggaggcccuuuaucccaacaaugaaguccagcggagaaacauugccaaucgcgauuuuguguaccugcucauggacgauguucuguucuaccaacggccucugaaaaccaagaaaagccucaucgcuaacugccccuaugaggagaacgaauacguggacagagagacaggcgaaauuaagaaggcgccgcugaaauguaucgccaagucucacccucuuuuccaggaguuucgccuguggaauuuccucuccaacauucggaucuaucagaaagagaaggaaaucaaugggacccugcaucuggacgucgaugugaccgcugaguuucuuaaaacagaagacgauuacguugcccucuucgacuggcugaacagcagaaaggagauugaacagaagacguuucugaaauaucccaaguucggacucaaaaaggagaucuccaauuaccgcuggaacuauguggaggauaaacaauacccuugcaaugaaacccggcacgccauucugucuagacuugagaaggcuaacgucuguaucgacuuucugagcaaugaaaaagagguggcccucuggcauauucuguacuccgucagcgauaagcaggaaaucgagaaggcgcugcggacauucgcugccaaaaacggccuugacgagucuuuuguggaagccuucaagaaauuuccucccuucaaguccgaguauggggcuuacagcgccaaagcuauuaagaagcuccugccccugaugcgcugcggaaaauauugggauguuucuagcaucgacgauaccacaaaggaaagaaucaaaaagauuguggccggcgaguacgacgaacggaucgcggucaaagugagagauaagguuaugaaucucuccgacauuucuuguuuuaagcgccugccgcuuuggcuggccugcuauaucguguacaaccggcacagcgaggacaaagaggcugucaagugggaaucccccgccgauauugacgcuuaucucgccagcuucaaacagcacucucugagaaauccuaucguggaacaggugaucaccgaaacgcugcgcguugucagagauauuuggaagcaaguggggcggaucgacgagauucauaucgagcuuggacgcgaaaugaaaaaccccgcggauaagagaaagcggaugacagcccagauucucgagaaugaaaacgcuaaccugcgcaucaaagcccugcucgcugaguucaugaauccugaauacgagaucgagaacgugagacccuacuccccgagccagcaggaaauucugcggaucuaugaggacaugguccuucacgccgaagaucaacugccugaggaaauugacgccauccucaagaaauuuaauucuuccaaggugcccaccaaaagcgaguuccugcgcuacaagcuguggcuugagcagaaauauagauccccuuacaccggcgaacucauuccccugggcaagcuguuuacagcugcguaugagaucgaacauguuaucccucagucucgguacuucgaugacagcuuuuccaacaaggugauuugugagucugccgucaauaaacucaaggauaaccagcugggguaugaguucaucaaaaaucaccauggacaaaagguggagguuggcuuugggaaaagcguggagauuuucuccgucgacagcuacgaacgcuuugugaaggagcaguacgcuaagucugccguuaaaaugaagaaaaugcuuauggaugacauccccgaacaguucauugagagacaacugaacgacucccgguauaucagcaaggugauuaaaggacuccugucuaauaucgucagagagaagaacgauuccggcgaauacgagccggaagccgugagcaagaauaucguggucugcaccgggucuguuacagaccgccugaaacgggauuggggcaugaacgacguguggaauagcauuguguauccuagauuugagcgccuuaacucccugacggauacccagagcuucggacacugggaaaauaagucuggcaaaaaggucuuucagacagagcucccccuggaguaccagaaaggguucuccaagaagcggaucgaccacagacaucacgcuauggaugccauugugaucgcgugugcuacccgcaaccauguuaacuaucucagcaaugaauccgccucucggaacgccaaaauuagcagauacgaccugcaacgccuucugugcgauaagucccggacagacgauaauggaaacuauaaaugggugaucaagaaacccugggacaccuucacgcaggacgcuagagagguccucucuaagaucgugguuagccugaagcagaaucugcggauuaucaacaaaaccacaaauguguaccgccaccuugaugccaccggcaacagagucuacgaaaagcagaaaacaggggacuccugggcgauucggaagccuaugcacaaagauaccguguuuggagcuguuaaucugcgcaaggugaaagucgugagacucucuguggcccuggacgccccgacgaugaucgucgauaagcggguuaagaacaaaguguucgagcuccugagcuauaaguacgacaaaaagagaauugaaaaauauuuuaaggagaaugcugugcuuuggaaggagcuggaucucgcccgcgucgcuguguacuauuucacagaagccaccacagagccccugguugcggugcggaaaccucuggacuccaccuuuaacgaaaagaaaaucaaggagagcgucaccgauacaggcauccaaaagauucuucugaaucaucucugcacgaaggaagggaagcccgaccuggccuucucugcugagggcaucgaggaaaugaacagaaaucuccugcagcuuaacaacggaaaacgccaccagccuauuuacaaggugcggguuuaugagcccagaggcaauaaauuuuccguggggguccugggaaacaagggcaccaaauggguggaagccgcuaaggggacaaaucuguucuuugccaucuacauuaccgaggauggaaagcgcacauacgagaccaucccucucaacauggucauugaacgggagaaacagggccuggcccccgugccggacaagaaugaaaaaggggauaaacuucuguucuggcucagcccuaacgaccugguuuaucuccccacggaggaggaacuggaguuuggcagaaucaaugaaccuaucgaccgcggaagaauuuacaagauggugucuuccagcggcaaccaauguuucuucaucccccagucuauuuccaaugcuaucauuccgacaaaggagcuuggggcgaacaauaaagccgaacggagcugggauggagcuaugaucaagaacaucugcauuccugucaagguggaccgccugggcagaaucauugagguuaaauaucggaucaaugaauga

SEQ ID NO: 4585 - RNA, 4530 nt, Artificial Sequence
  Cas9 variant
augaagaccauccugggccucgaccuggggacaaacagcgugggaugggccgucauuaauuccguuaucaaagagcaggcugaaagaauuuggaucgagauggccggcucucggauuauccccauggaugcggcugugcuuggggacuucgauaagggaaacagcaucucccaaacgucugaacgcaccagacugcggggcgcccgcagacuccgggagcgccagcugcuuagacgggaacgccugcacaaagugcucaauauucugggguuucugccuaaccauuaccucgaguauaucgacuucgagaagcacccgggaaaauuucuggccgaugcugaacccaaacuugccugggucaaggacgagcagggcaaauacacauuccuguuucaggcugccuucgaugaaaugcucgcggacuuugccauucaucaaccuagccugguguccggcgauaagaaaauccccuaugacuggaccauuuacuaucuuagaaagaaagcucugacagagaugaucucuaaggaggaacucgccuggauucugcugaauuucaaccagaagcggggguacuaucagcuccgcggagaggaagaggaagauaaugcuggcaaaagcguugaguuuuacgcccugaaggugcuuaccgucgaggcgacagacgaaaagaaggggagagaugugugguacaacguucaccuggagaauggauggaucuaucggcgcuccagcucugugccucucgacugggaaggccaggucaaagaguucaucgugaccacggaccugaaccccgaugggaccccuaaacuugacaaauacggagaagugaagagauccuuucgggccccgaaggaggaugacuggaugcugauuaaaaagagaacagaggcugauaucgccaauacccauaaaacagucggcgcuuauauuuacgacacccuccugcaaaagccccagcagaaaaucauuggcaagcugguuaagacgguggaacgcaaacucuaucgggaugagcugagccuuauccugcagaagcaaugcgccuuccacgccgaacuccaggacagagcucuguacgcgcgcuguguggaggcccuuuauccuucuaacgaaguccggagaaagaauaucgcuaaccgcgauuuuguguaccugcucauggacgauauucuguucuaccagcggccccugaagaccaaaaagucccucaucgccaauugcccuuaugaggagaacgaauacguugacagagagacaggggaaauuaagaaaacaccccugaaguguaucgccaaaagccacccgcuuuuccaagaguuucgccuguggaacuuccucucuaauauucggaucuaucagaaggagaaagaaaucaacggaacccugcaucuggacguggaugucaccgcugaguuucuuaagacagaagacgauuacguggcccucuucgacuggcucaauuccagaaaggagauugaacagaaaacguuucugaaguauccuaaauucggccugaagaaagagaucagcaacuaccgcuggaauuauguugaggauaagcaguaccccugcaacgaaacccggcacgcgauucuguccucucuugagaaagcuaauguguguaucgacuuucugagcaacgaaaaggaggucgcccucuggcauauucuguacuccgugagcgauaagcaagaaaucgagaaagcccugagaacauucgcugccaagaaugggcuugacgagucuuuugucgaggcuuucaaaaaguuuccucccuucaaauccgaguauggagccuacagcgcgaaggccauuaagaaaaugcucccccugaugcggugcggcaaguauugggaugugucuagcaucgacgauaccacaaaagaacgcaucaagaaaauuguuaccggggaguacgacgaaagaaucuccgugaagguccgggauaaggugaugaaccugucugacauuagcuguuuuagacgccucccucuguggcuugcuugcuauaucguuuacaaucggcacuccgaggacaaagaggccgugaagugggaaagcccggcugauauugacgccuaucuggcgucuuucaaacagcacucccucagaaaccccaucgucgaacaggugaucacggaaacacugcgcgugguuagagauauuuggaagcaggucggacggaucgacgagauucauaucgagcugggccgcgaaaugaaaaauccugccgauaagagaaagcggaugaccgcucaaauucuugagaacgaaaaugccaaccuccgcaucaaagcucugcuggccgaguucaugaaccccgaauacgagaucgagaaugugagaccuuacagccccucucagcaggaaauucuccggaucuaugaggacaccgugcugcacgccgaagaucagcuuccggaggaaauugacgcuauccugaagaaauuuaacuccagcaaggucccuacaaaauccgaguuccuccgcuacaagcuguggcuggagcaaaaauauagaucucccuacaccggcgaacuuauuccucucgggaagcuguuuacagcggccuaugagaucgaacaugugaucccccagagccgguacuucgaugacuccuuuucuaauaagguuauuugugagagcgcugugaacaaacugaaggauaaucagcucggauaugaguucaucaaaaaccaccauggccagaaggucgaagugggguuuggaaaauccguugagauuuucagcguggacucuuacgaacgcuuugucaaggagcaauacgccaaguccgccgugaaaaugaagaaacugcuuauggaugacaucccugaacaguucauugagagacagcugaaugacagccgguauaucucuaagguuauuaaaggccuccuguccaacaucgugagagagaagaaugauagcggggaauacgagcccgaagcugucucuaagaacaucguggugugcacgggcagcgucaccgaccgccugaaacgggauuggggaaugaaugacguuuggaacuccauuguguauccgagauuugagcgccuuaauagccugacagauacccaaucuuucggccacugggaaaacaaguccgggaaaaagguguuucagacagagcucccucuggaguaccagaaaggauucagcaagaagcggaucgaccacagacaucacgccauggaugcgauugucaucgcuugugccacccgcaaucaugugaacuaucucuccaacgaaucugccagccggaaugcuaaaauuuccagauacgaccugcagcgccuucugugcgauaagaaccggacggacgauaauggcaacuauaaauggguuaucaagaaacccugggacaccuucacacaagacgccagagaggugcucucuaagaucgucgugagccugaagcagaaucugcggauuaucaacaaaaccacaaauguuuaccgccaccuugaugcgaccgggaacagaguguacgaaaagcagaaaacgggagacuccugggcuauucggaagcccaugcacaaagauacagucuuuggcgccgugaaucugcgcaagguuaaaguggucagacucucuguggcccuggacaccccugcuaugaucguggauaagcgggucaagaacaaaguuuucgagcuccugagcuauaaguacgacaaaaagagaauugaaaaauauuuuaaggagaaugccuuccuuuggaaggagcuggaucucgcuaaaguggccguguacuauuuuacagaagcgaccaccgagccgcuggucgccgugcgcaagccccuggacuccacauucaacgagaaaaagaucaaagaaagcguuacggauaccgggauccagaagauucuucugaaucaucucugcacaaaggaaggcaaaccugaccuggcuuuuucugccgagggaaucgaggaaaugaaccggaaucuccugcaacuuaacaacggcaagucccaccagcccauuuacaaagugagagucuaugagccucgcgggaauaaguucagcgugggaguucugggcaacaaagggaccaaguggguggaagcugccaagggaacaaaucuguuuuucgccaucuacauuaccgaggauggcaaacggacguacgagacaaucccccucaacgucgugauugaaagagagaagcaggggcuggucccugugcccgaccgcaauaaaaagggcgauaaacuucuguuuuggcucucuccgaacgaccugguuuaucucccuaccgaagaggaacgggaguucggaagaaucaaugagcccaucgaccgcggcagaauuuacaagaugguguccuguaccgggaacgaaggacauuucaucccugcuaaugucgcgaaccccauugugccgguuaucgagcugggcagcaauaacaaagcccagcgggcuuggacaaaugaaaugauuaaggauaucugcaucccuauuaagguggaccgccuugggcacaucauugaggucaaauauagaaucgaugaauga

SEQ ID NO: 4586 - RNA, 4530 nt, Artificial Sequence
  Cas9 variant
augaagaaaauccugggccucgaccuggggaccaacagcgugggaugggccgucauuaauuccguugugaacgaugagggcaaggaacagcuugugaauaucucuagcugcggguccagaauuauccccauggacgcugccacacugggagauuucgacaaaggcaacucuaagagcccugucgcggagcggacgcgccucagaggggugcggcgccugcuugaaagaucccugcuccggcgcgagagacugcaccggguucugucugugaugggauuucucccggaacauuacgcugcccaacuggaucgcuauggcaaauuccuucccgagaccgagccuaagcuggccugguacaaggacgaaacaggcaaauauagauuucucuuccaggauagcuuuaaugagaugcuggaagacuuccacgagcaucaccccgagcuugucgcugaagggaagaaaauucauuacgauuggaccaucuauuaccugcggaagaaagcccucucccagaagaucacaaaggaggaacuggcuuggauucugcucaacuuuaaucagaaacgcggauauuaccaacugagaggcgaggaagaacaggaggacaacaagaaaagcguggaauacuaugcccuuaagguuguggcggucgaggauucuggggaccggaaaggaaaggauaucugguacaaugugaaacuggaaaacggcuggguguaucgcagagccuccggggucccucucgacuggguuggaaaggugaaggaguucauugugaccacagaccuggaugaaaaaggcaaucccaagaaagacaaggauggcaacgucaaacggagcuuuagagcuccuaaggaggacgauugggggcuucugaagacccgcacgcaggcccagaucgacgagucuggacaaaccgugggcacauacauuuaugaaucccuccugcggaugccggaucagaaaaucagagggaagcugguucgcaccauugagcggaaauacuauaaggacgaacucagaaaaauccugaucaagcagagcgaguuccacacagcccuucaggaucacaaucugcuccuggcuuguauugaagaacuuuaccccaacaaugaggcgcaucgccggcugcucucuaccuccgacuuuacguacuuccugguggaagauauccuguuuuaucaaagaccucucaagagccagaaaggacagauugacgacugccccuacgagucccacgucuaucgcgauaagaaagacggcucucugcaacaugugccucuuaaguguguuagcaaaucccacccccuguuccaggaguuccggcucuggcacuuucugagcuuccugagaaucuaccagcgcgagcggaugauugaugggucucuuaagcucgacguggaugucacaaacgaguuucugcagaacgaagacgauuaugugaagcuguucgacuggcucaaugagagaaaagaaaucgaucaaaagaccauccuggccuacaaaccguuuggacuuaagaaaaacgagcaguccaaguaucgguggaauuacgucgaagacaaaagcuacccuugcaacucuacacgcgcugauaugauuuucagacugagcaaggccggcgugcccgaggaguuucucacccgggaaaaggaggaagcucuguggcauauccuguauuccauuucugacaaaaaggagcuuaccaaagcccucggcacauucgccgaaaagaaugggcugaacgagacguuuguugagaucuucagcaaaaugccucccuuugaauccgauuacgcugcguauagccugaaggccauuagaaagcuccuggcucuuaugcgcaugggaaaauacugggacgagcaggccaucgacgaacacacccggucuagaaucgagaagauucugacaggcgaauaugaugagaccauccgcacaagagugcgggagaaagccaugcaucucaccgacauuuccagcuuccgcgggcugccccuguggcuugcuuguuacgucguguaugauagacacucugaagccaaggagcucguuaaaugggaaacgccugacgauaucgaccauuuucugcggaaguucaagcagcacucccugcgcaauccgauuguggagcaaaucauuauggagacacucagaaccguccgggauaucuggaaacaggaaggaaagaucgacgagauucacguggaacugggccgcgagaugaaaaaccccgcgaaggaaagagcucggaucaccgcccaggugcuugagaaugagaacacaaaucugcgcauuaaagcccuccuggcugaguucaugaacccugaguuugaaaucgagaauguuagacccuacagcccugcccagcaagaaauucugcggaucuacgaggaggggguccuuuccggcguggcugaaaaggaucuccccgacgauaucgccucuauucugaagaaauucagagagaacgacgugaagaaacgcccgaccacaagcgaaguccugcgguauaagcucuggcuggagcagagauaccgcuccccuuauacgggacggaucauuccccuuggcaaacuguuuaccccugcguacgaaaucgagcaugugauuccccagucuagauauuucgaugacagcuuuacaaauaagguuaucugcgaguccgccgugaacaaacucaaggacaacugucugggguacgaguucgucaagaaacacagcggagaaaagguggaacugggcaauggggagaccgcuacaaucuuuucuguugaggaauaugagcgcuucgugaaagauuccuacuuuaacaauagcaagaaaauuaagaaacuucugcucgaagacaucccugauaacuucauugagcggcagcugaaugacucuagauacaucuccaaagucguuaagagccuccugucuaacauugugugcgaagagggagagcaagaaggcaugagcaaaaaugugaucgucuguaccgggggcgugacggaucgccuuaagaaagacuggggagugcaggaugucuggaaccggaucauucugcccagauuucuccggcugaauaagaugaccgaccgcacagauuucaccgccguuuccacaaacggccaucugcuuccggcugugccucugcaccuccagaagggguuuaauaaaaagagaaucgaccaccggcaucacgccauggaugcgauugugaucgccugcgcuggacgcaacauugucaauuaucugaacaaugccagcgcuagaaaaggcucugagaucucccgguacgaccuccaacaucugcuuugugacaaggugaaaaccgaugccaacgggaacuauaaguggauucugagaaagcccugggaaacguucacacaggaccucuacgccgcucugaccaauaucguugugagcuucaaacagaaccugcgcgucaucaaucggacaaccaaccacuaucagcauuacaaugaggauggagaaaagaaaaugauuccccaaaccaagggcgacagacuugcgauccgcaaaccuaugcacaaggauacaguguauggggagguuaaccugcggaaggagaaaacgcucccgcugaaggacguggucaaaaaucccuccgccgugguugauaagucucucaaaaacaagcuguacgaacuucugaaaagccaguacgaccugaaggcuauuaccaaguauuuugagacacaccaggaugugugggccgacgucaaucucaaaaagaucaaaguguacuauuucaccaaggaaacaaacgagagauuuuucgccacccgcaaaucccuggauucuagcuuuucccagaagaagauugaagaggaggugacggacacaggcauccaaaagauccuucugcggcaucuccagcagaauggaaacaauccugauauugcuuucucucccgacggcgucgaaagaaugaaccagaauaugaccauccugaacgacgggaaguggcaccaaccuauuuacaaaguucgcaccuaugagaaggccgauaaauuugcggugggagaaaagggcaacaaggugaaaaaguucgucgaggcugccaaagggacaaaucucuuuuucgccguguacgagagcauccaggaagacgaggcuaccggaaagcagguuagaaaacggacauuugccacgauuccccugaacgaagugaucaagcgcaagaaacaaggccuuccugcggcucccgaggauuccaaggggaaucugccgaucuucguccugagcccuaacgaccucguguaucugcccaccgaagaggagagaaauucuggcaaaauuauccagccucuugaucgggaacgcauuuacaagaugguuuccugcacagagggagaaugccauuguauccccgaguacguggccaacccgauucugcagaccaucgaacucggcagcaauaacaaagcccagagagcuuggucuggggagaugauuaaggagaucugcgucccugugaaagucgaccggcugggaaaugugucccucaucaagauuuga

SEQ ID NO: 4587 - RNA, 4530 nt, Artificial Sequence
  Cas9 variant
augaagaccauccugggccucgaccuggggacaaacagcgugggaugggccgucauuaauuccguuaucaaagagcaggcugaaagaauuuggaucgagacggccggcucucggauuauccccauggaugcggcugugcuuggggacuucgauaagggaaacagcaucucccaaaccucugaacgcacaagacugcggggcgcccgcagacuccgggagcgccagcugcuuagacgggaacgccugcacaaagugcucaauauucugggguuucugccuaaccauuaccucgaguauaucgacuucgagaagcacccgggaaaauuucuggccgaugcugaacccaaacuugccugggucaaggacgagcagggcaaauacaccuuccuguuucaggcugccuucgaugaaaugcucgcggacuuugccauucaucaaccuagccugguguccggcgauaagaaaauccccuaugacuggacaauuuacuaucuuagaaagaaagcucugaccgagaugaucucuaaggaggaacucgccuggauucugcugaauuucaaccagaagcggggguacuaucagcuccgcggagaggaagaggaagauaaugcuggcaaaagcguugaguuuuacgcccugaaggugcuuacagucgaggcgaccgacgaaaagaaggggagagaugugugguacaacguucaccuggagaauggauggaucuaucggcgcuccagcucugugccucucgacugggaaggccaggucaaagaguucaucgugacgaccgaccugaaccccgaugggacaccuaaacuugacaaauacggagaagugaagagauccuuucgggccccgaaggaggaugacuggaugcugauuaaaaagagaaccgaggcugauaucgccaauacacauaaaaccgucggcgcuuauauuuacgacacgcuccugcaaaagccccagcagaaaaucauuggcaagcugguuaagacaguggaacgcaaacucuaucgggaugagcugagccuuauccugcagaagcaaugcgccuuccacgccgaacuccaggacagagcucuguacgcgcgcuguguggaggcccuuuauccuucuaacgaaguccggagaaagaauaucgcuaaccgcgauuuuguguaccugcucauggacgauauucuguucuaccagcggccccugaagaccaaaaagucccucaucgccaauugcccuuaugaggagaacgaauacguugacagagagacaggggaaauuaagaaagcgccccugaaguguaucgcuaaaagccacccgcuuuuccaagaguuucgccuguggaacuuccucucuaauauucggaucuaucagaaggagaaagaaaucaacggaacccugcaucuggacguggaugucaccgccgaguuucuuaagacagaagacgauuacguggcccucuucgacuggcucaauuccagaaaggagauugaacagaaaacguuucugaaguauccuaaauucggccugaagaaagagaucagcaacuaccgcuggaauuauguugaggauaagcaguaccccugcaacgaaacccggcacgcuauucuguccucucuugagaaagccaauguguguaucgacuuucugagcaacgaaaaggaggucgcccucuggcauauucuguacuccgugagcgauaagcaagaaaucgagaaagcucugagaacauucgccgcuaagaaugggcuugacgagucuuuugucgaagccuucaaaaaguuuccucccuucaaauccgaguauggagcguacagcgccaaggcuauuaagaaaaugcucccccugaugcggugcggcaaguauugggaugugucuagcaucgacgauaccacaaaagaacgcaucaagaaaauuguuaccggggaguacgacgaaagaaucgccgugaagguccgggauaaggugaugaaccuguccgacauuucuuguuuuagacgccucccucuguggcuugcuugcuauaucguuuacaaucggcacagcgaggacaaagaggccgugaagugggaauccccggcggauauugacgccuaucuggcuagcuucaaacagcacucucucagaaaccccaucgucgaacaggugaucacggaaacacugcgcgugguuagagauauuuggaagcaggucggacggaucgacgagauucauaucgagcugggccgcgaaaugaaaaauccugccgauaagagaaagcggaugaccgcucaaauucuugagaacgaaaaugccaaccuccgcaucaaagcccugcuggcugaguucaugaaccccgaauacgagaucgagaaugugagaccuuacucccccagccagcaggaaauucuccggaucuaugaggacaccgugcugcacgcggaagaucagcuuccggaggaaauugacgccauccugaagaaauuuaacucuuccaaggucccuacaaaaagcgaguuccuccgcuacaagcuguggcuggagcaaaaauauagaucccccuacaccggcgaacuuauuccucucgggaagcuguuuacagcugccuaugagaucgaacaugugaucccccagucucgguacuucgaugacagcuuuuccaauaagguuauuugugagucugccgugaacaaacugaaggauaaucagcucggauaugaguucaucaaaaaccaccauggccagaaggucgaggugggguuuggaaaaagcguugagauuuucuccguggacagcuacgaacgcuuugucaaggagcaauacgcuaagucugccgugaaaaugaagaaacugcuuauggaugacaucccugaacaguucauugagagacagcugaaugacucccgguauaucagcaagguuauuaaaggccuccugucuaacaucgugagagagaagaaugauuccggggaauacgagcccgaagcggucagcaagaacaucguggugugcacgggcucugucaccgaccgccugaaacgggauuggggaaugaaugacguuuggaacagcauuguguauccgagauuugagcgccuuaauucccugacagauacccagagcuucggccacugggaaaacaagucugggaaaaagguguuucaaacagagcucccucuggaguaccagaaaggauucuccaagaagcggaucgaccacagacaucacgcuauggaugccauugucaucgccugugcuacccgcaaucaugugaacuaucucagcaacgaauccgccucucggaaugcgaaaauuagcagauacgaccugcagcgccuucugugcgauaagaaccggacggacgauaauggcaacuauaaauggguuaucaagaaacccugggacaccuucacacaagacgcuagagaggugcucuccaagaucgucgugucucugaagcagaaucugcggauuaucaacaaaaccacaaauguuuaccgccacuuugaugccaccgugaacagagucuacgaaaagcagaaaacgggggacagcugggccauucggaagcccaugcacaaagauacaguguucggagcuguuaaucuucgcaaggugaaagucgugagacuguccguggcccucgacaccccugcuaugaucgucgauaagcggguuaagaacaaaguguuugagcugcucucuuauaaguacgacaaaaagagaauugaaaaauauuucaaggagaaugccuuucuguggaaggagcuugaucuggcgaaaguggccgucuacuauuucacagaagcuaccaccgagccgcucguggccguucgcaagccccuggacagcacauuuaacgagaaaaagaucaaagaauccgugacggauaccggcauccagaagauucugcuuaaucaucugugcacaaaggaagggaaaccugaccucgcuuucagcgccgagggcaucgaggaaaugaaccggaaucugcuccaacugaacaacggaaagucucaccagcccauuuacaaagucagaguguaugagccucgcggcaauaaguuuuccguuggggugcuuggaaacaaaggcaccaagugggucgaagccgcuaaggggacaaaucuguucuuugcgaucuacauuaccgaggauggaaaacggacguacgagacaaucccccugaacguggucauugaaagagagaagcagggccucgugccuguucccgaccgcaaugaaaaaggggauaagcugcuuuucuggcugagcccgaacgaccucguguaucugccuaccgaggaggaacgggaguucggcagaaucaaugaacccaucgaccgcggaagaauuuacaaaauggucucuuguaccggcaacgaggggcauuuuaucccugccaauguggcuaaccccauuguuccggugaucgaacucggauccaauaacaaggcccagcgggccuggacaaaugagaugauuaaagauaucugcaucccuauuaaggucgaccgccugggccacaucauugaagugaaguauagaaucgaugaguga

SEQ ID NO: 4588 - RNA, 4530 nt, Artificial Sequence
  Cas9 variant
augaagaaaacccugggccucgaccuggggacaaacagcaucggaugggccgugauuaauuccaacaucgauucugagggcaaggaaaaacuugucgggauuagcuccugcggaucuagaaucauucccauggacgcuacgacccugggcgauuucgggaagggaaauacaaaaagcccuguugccgagcggacccgccucagaggcauccggcgccugcuugaaagaucccugcuccggcgcgagagacugcaccgggugcugucugugaugggcuuucucccggaacauuacgcgagccagcuggaccgcuaugggaaguuccuucccgagacagagccuaagcuggcuugguacaaagaugacuccggaagauaucaauuucucuuccaaaagagcuuucacgaaaugcuggaggauuuccggcagcaucagcccgaacuugucgccggcgagaaaaagaucccuuacgacuggaccauuuauuaccugcgcaaaaaggcccucucucaggagaucacaaaggaggaacuggcuuggauucugcucaacuuuaaucagaaaagaggguauuaccagcugcggggagaagaggaacaggaggagaacaauaaguccguggaauaccacgcccuuaaaguugugagcgucgaggauucuggcgaacgcaaggggaaagacaucugguauaacgugacccuggagaauggauggguuuacagacgggcuuccaacauuccccucgauuggacgggcaaggugaaagaguucgucgugaccacagaacuggacgaugccggcaauccuaagaaggacaaagaggggaacgugaagagauccuuucgcgcgccgaaagaagacgauuggggacuucugaagacccggacacaagcccagaucgacgagucuggcaaaaccgucgggacguauauuuacgaaucccuccuguguaugcccaaucagaagaucagaggaaagcugguucgcacaaucgagcggaaauauuacaaggaugaacucagacagauucuggugaaacaaagcgaguuccaugcugcccuucaggaccacaaccugcuccuguccugcaucgaggaacuuuauccuaauaacgaggcucaccgccggcugcucucugccagcuccuuuauuuacuuccugaucgaagauauucuguuuuaccagagaccccucaagagccaaaaaggccugaucgacaacuguccuuaugagucucauaucuacaaggauaagaaagacgggucccuucaccaugugccccugaagugcgucagcaaaucucacccccucuuccaggaguuccgccuguggcaguuucugagcaaucuucggauuuaucagagagaacgcaugauggauggaucccucaagcuggacguggauguuacccgggaguuccugccuucugaagaggacuacgugaaacucuuugacuggcugaacgaaagaaaggagaucagccaaaaguuccuucuggcguauaaacccuuuggccucaagaaaaaugagcaggccaacuaccgguggaauuaugucgaagauaaguccuacccuuguaacgagacacgcgcugaaauuaaaagcagacugucuaaggccggcgugcccgaggaguuccugaccgaagagaaagaagaggcucuuuggcacauccucuacuccauuagcgacaagaaggaacugaccaaagcccuggggacauuugccgcuaagaauugccucaacgagucuuucguugaaguguuugcgaaaaucccgccuuucgaguccaauuaugccgcuuacagccugaaggccauccggaaacuucuggcccucaugagaaugggaaaguauuggaacgagcaggcuauugaucgccagacgcgggacagaaucgaaaagauucugaccggcgaguacgaugaaacaauccgcuccagaguccgggagaaagccaugcugcuuaccgacauuucuagcuuucgcgggcucccgcuguggcuggcguguuauaucguguacgauagacauuccgagucuaaggaacucgucaaaugggagacacccgcugacauugaucacuuccugagcaaguuuaaacaaaauucccuucggaacccuaucguggaacagguuaucaccgagagccugcgcacggugagagacauuuggaagcaggaaggaaagaucgaugagauucaugucgagcucggccgggaaaugaaaaaucccgccaaggagcgcgccagaaucacagcucaggugcaagaaaacgagaauaccaaccugcggauuaaagcccugcuugcugaauuuaugaacccugaguucgagaucgaaaauguucaccccuauucuccggggcagcaggagauccuccgcauuuacgaagacggcgugcuguccggaaucgccgagaaggaucugccugacgacauuaccgcgauccucaaaaaguucagagaaaacgaugucaagaaacggcccacaaccagcgaggugcugagauacaaacuuuggcuggagcagcgcuaucggucuccuuacacaggcagagugauuccccucgggaagcuguucacgccugccuaugaaaucgagcauguuaucccccaaucccgcuacuuugacgauagcauuucuaauaaggucaucugcgaaagcgcugugaacaaacugaaggacaauugucuuggauaugaguucauuaaaaagcacuccggcgagaugguggaacuggggaacggagagaccgucccgguguuuagcguugaagaguacgaacgguucgugaaggagucuuauuuuggcaauuccaaaaagaugaaaaagcuccugcucgaggauaucccugacagcuucauugaaagacagcugaacgauucccgcuacaucucucgggucgugacaagccuucuguccaaucucguuugcgaggaaggggagcaggacggccugucuaaaaacgugaucgucuguaccggaggcauuacagauagacugaagaaggacuggggagugcaagaaguuuggaaucgcaucauucuuccccgguuucugagacucaacgagaucaccgggcggacggauuucaccagcacauccgugaauggccaucugcuccccgcccugccucuuuaccugcagaaaggguuuaacaagaaacgcauugaccacagacaccaugcuauggaugccaucgucauugcgugcgccaaucggaacaucgugaacuaucucaauaacucuagcgcucgcaagaauagcgagaucagcagauacgaccugcagcggcugcuuugcgaaaaagugaagaccgacgccaacggaaauuauaaguggauucugagaaaaccgugggagacauucacccaggaugucuacgcugcccucacgaacaucguugugucuuuuaagcaaaaucugcgcgugauuaaccggacaaccaauuauuaccagcacuauaacgaagccggcgagaaaagaaugaucccccagacaaagggggaccgcugggcuauucggaaaccuaugcacaaggauaccgucuacggcgaagugaaucucagaaaggagaaaacccugccccuucgcgacguugugaagaacccuuccaucgucguggauaaaagccugaagaauaaacuguacgagcuccugaagucucaguaugaccuuaaggcgaucgccaaauacuucgaaacacaucaagauguuugggcugacgugaaccugaagaaaauuaaggucuauuacuucacgaaagagaccaaugaacgguuuuucgccacaagaaagucccucgaucccagcuuugaccagaaaaagaucgaggaggaagugaccgauacaggaguucagaagauucugcuccaccaucugcagcaaaacaacaaugacccugacauggccuucucucccgauggcaucgaccgcaugaaccagaauaugaccauucuuaacgaugggaaauggcaccagccgaucuauaaggugagaacguacgagaaagcugacaaguuugccgucggagaauccggcaauaaagcgaagaaguucguggaggcugccaaagggacaaaccuguuuuucgccguguaugaaagcguccaagaggaugaggcuaucggaaagcagguuuguaaacggaccuuugccaccauuccucugaaugaagugaucaagcgcaaaaagcagggccuccccgcggcuccugaggaccugaacgggaaucuucccaaguucgugcuguccccgaacgaucucgucuaccugccuacagaagaggaaagaaauagcucucggauuauccagccccucgaccgcgagagaauuuacaaaauggugagcuccucuggcagccaaugcuuuuucaucaagguuuucguggccaacuccauuugggauaaaaaugaguauucuagccugaacaagauggaacgggccaucaccaaugagaugaucaaagaaauuugugucccuaucaagauugacagacuuggaaacgugucccugauccagauuuga

SEQ ID NO: 4589 - RNA, 4533 nt, Artificial Sequence
  Cas9 variant
augaagagaauccugggccucgaccuggggaccaacagcauuggaugggcccuuguggauuccgaggaacagcggauccugggcauggggucucgcauuauccccauggaccaaggaguccucgauacauucagcggcgggaauccuguugagacgcagaccgcugccagaacaguguaccggggaacccgcagacugcgggaacgcgcgcuucugagacgggagcgccucauuagagugcugaacaugaugaaauuucugccggaacacuaugcuucccagaucgacuucgagaagcggcucggccaguuuuucgaugagaaagaacccaagcuggccuggaaacaaaaugacgagggccgcuuugaauuuaucuuucagcagucuuucaacgagaugauugaggaauuuaagaauaagggggucgugagagaggauaaaaagaucccuuacgacuggacaauuuauuaccuucggaaaaaggcccugagccaggaaaucgagaaagaggaacucgcuuggauucugcuuaacuucaaucaaaagcgcggauauuaccagcugagaggcgaggaagaggaagagaaccccaauaagcucguugaauauuacucccugaaaaucguggaugucauugccgacgagaagccuaacucuaaaagcgauaucugguacucccugcaucucgagaauggguggaucuaucggagaagcucuaagauuccccuguuuggauggaaagacaagacccgcgauuucaucgugacaaccgaccuuaacgacgauggcacgguuaaaaaggacaaggaagggauugagaaacgguccuuuagagcuccuagcgaaaaugauugggugcugcucaagaaaaagaccgagucugacaucgaaaaaucccacaagacagucggagccuacguguaugagacccugcuucagaacccgaugcagaaggugcgcggcaaacugguccggacaauugagagaaaguucuacaaagaugaacucaagcaaauccuggagaaacagcgcgaauuucaucccgagcugcgggacgaggaucucuauaaugacugcguuagagaacuguaccgcagcaacgagaccuaucaguuuauccuuucuaagcgggauuucgugcaccuguuucucgacgauauucuguucuaccaaagaccucuucgcucccaaaagagcgcgaucggcgacuguauucuggaauuuaaaacguacaaggacaaagaugggaacaauaucaaggaguaucucaaagugauuuccaagucuaacccccuguaccaggaguuccggaucuggcaguggcuguauaaucucaagaucuacagaaaagaagacgaugaggacgucacacugcaguuuauugccaacaucgaagauaaggagcagcuuuucgacuuucugagcaaucggaaauccauugaacagaagccucuccuggaguaucugaucaaagcuaagggacuuaaaaagcaagugaagaccgaagccuaccgcuggaacuauguugaggauaaaauuuaccccugcagcgagacaaagaccaugaucucuaccagacucgcuaaaguggaaaauauuccggacaacuucuuuacaaaggagaucgaacagaaacuguggcauaucauuuacuccgucacggauaagaaugaguucgaaaaggcccugcggaccuuugcgaaaaaguaugaccucgauaucgccagcuucguggacaacuucaaaaagauuccucccuuuaaaaaugaguacggcucuuucagcgagaaggcuaucaagaaacugcuuccucugaugagacucgggaaguauuggaaauggaacgauauugacaauaacacacagaaucgcaucuccaagaucauuaccggagaauacgacgaggaaaucaaagauauuguucgggagaagucuaucgcccugacaaacgagaacgacuuucagggccugcagcuuuggcucgcucaauaucugguguacgggagacacagcgaagccgauauugccggaaaguggcacuccgucgcugaccuggagaaauaucucaaugaguucaagcagcauagccugcgcaaccccaucguggaacagaucauuaccgaaacgcuuagagucgugcgggauaucuggcgcaaauacggccagggcgcggagaauuucuucucugagauucacguugaacuggggagagacaugaagaacacagccgaugagcggaaaaagaucgugaaugucgugaccgaaaacgagaauaccaaccuccgcauuaaagcucugcugauggaacuuaagaauaacuccgacggaaagcucgagguugagaaugugagacccuacagcccuacacaacaggauauccugaaaaucuaugaagaguacgccauuucuaccggccuggacaacgaaaaggaugagaaagucaaggaagacaucaaaaagauuucccggguggcccagccgacaacgaccgagcuccaacgcuauaagcuguggcuugagcagaaauacuguagccccuauacagggaaggugaucccucugggaaaacucuuuaccgaagaguaccagauugaacauaucauucccaaguccagauauuacgaugacucuuucagcaauaaaguuaucugcgaggcugccgucaacaagcugaaggacaaaugucugggccuugaguuuaucaagaauuaccacgggcagauuguggaaacaggcuucggacaaaaagugaccaucuuugaugaggaagcguaucagaacuucgucaagcagcacuacgcuuauaaccauuccaaacggacgaagcuccugcuggaggaaauuccugagaagaugaucgagcgccagaugaaugacaccagauacauuucuaaauuugugcucccccugcuuagcaaccugguucgggccaaggaaaaugauaacggcgucaauuccaaaaacgugcucccggugaaugggaagaucacaaccaugcugaaacaagacuggggacugaacgauguuuggaaugaccuuauccugccuagauucgugcgcaugaacgagcucgccaagacaauugcuuucaccagcuggaaugaacagcaccagaaguaucugcccacggucccucucgagcugucuaaaggcuuucagaagaaacggaucgaucauagacaccaugccauggacgcucuugugauugccugcgcgacacgcgaucacguuaaccugcucaauaacaagcacgccaauaccgacacaauccgguacgaucugcaaagaaaacugcgccuuuucgaacgggugaccuauauugacccccagaccaagaacaacgucacaaaagacaucccuaaggaguuuaagaaacccugggauaauuucacgguggacgcuagaaacgagcuggaaaagaucauuguguccuuuaaacagaaucuccgcaucauuaacaaggccaccaauaucuacacaaaauacgagaacgggaagaagauuaaagucggacaaaagggccugaauugggcuauccggaaaccgcuccauaaggaaaccguuuucgccaaagugagccugagaaagcggaagacagugcgccuuucugaggcgcugaaagauuggaagaaaauugucgacaagaaacucaagcaggaaaucaagagacugaccugucaguaugggaaauuugauguggacacgauccugcgguacuucaaggaucgcaaauaucaguuuggcgagguugacguguccaaggucaaaauguacuauuucgaugaggaaaacgccgcugugagaaagaauguugacaccagcuuuacagagaaauucauucaaggaucugugaccgauacaggcauccagaagauucuucugaaccaccucgaagccaaggggaauaaagucgagaucgcuuucagcccugagggaauugaagagaugaacaagaauaucauccagcugaacgaaggcaaacuccaucugcccauuuuuaaggugcggguuuacgagaccaucgggaauaaauucuccgugggagucaagggcaacaagaaagacaaguauguggaagccgccaaagggacaaaucuuuucuucgcuauuuacguggaugagaacggcaucagaagcuacgagacgauuccccugaacaucgucaucgaacgccugaagcagggacucucuguugugccugagaaaaaucggaaggaacacucccugcuguuuuaucuuagcccgaacgaccucguguacguccccauugaggacgaaagagagaauauccacgcggugaaccuggaucaacucaauaacgagcagcgcaagcggauuuauaaaaugguuuccugcaccggcucugaaugucauuucgugccuuacuaugucgccagccccaucgugaauaagguugaguacuccucucugaacaaaauugggagaagccuuacaggagaaaugaucaaggacgugugcauuaaacugaaggucgaucgccugggcaauaucaaggggaucuccggacucuga

SEQ ID NO: 4590 - RNA, 4533 nt, Artificial Sequence
  Cas9 variant
augaagagaauccugggccucgaccuggggaccaacagcauuggaugggcccuuguggauuccgaggaacagcggauccugggcauggggucucgcauuauccccauggaccaaggaguccucgauacauucagcggcgggaauccuguugagacgcagaccgcugccagaacagcguaccggggaacccgcagacugcgggaacgcgcccuucugagacgggagcgccucauuagagugcugaacaugaugaaauuucugccggaacacuaugcuucccagaucgacuucgagaagcggcucggccaguuuuucgaugagaaagaacccaagcuggccuggaaacaaaaugacgagggccgcuuugaauuuaucuuucagcagucuuucaacgagaugauugaggaauuuaagaauaaggggguggucagagaggauaaaaagaucccuuacgacuggacaauuuauuaccuucggaaaaaggcucugagccaggaaaucgagaaagaggaacucgccuggauucugcuuaacuucaaucaaaagcgcggauauuaccagcugagaggcgaggaagaggaagagaaccccaauaagcucguggaauauuacucccugaaaaucguugaugugauugcugacgagaagccuaacucuaaaggggauaucugguacagccugcaucucgagaauggauggaucuaucggagauccagcaagauuccccuguuuggcuggaaagacaagacccgcgauuucaucgucacaaccgaccuuaacgacgaugggacggugaaaaaggacaaggaaggaauugagaaacggucuuuuagagccccuuccgaaaaugauuggguucugcucaagaaaaagaccgagagcgacaucgaaaaaucucacaagacagugggcgcguacgucuaugagacccugcuucagaacccgaugcagaaggugcgcggcaaacuggugcggacaauugagagaaaguucuacaaagaugaacucaagcaaauccuggagaaacagcgcgaguuccaucccgaacugcgggacgaggaucucuauaaugacugcgucagagaacuguaccgcuccaacgagaccuaucaguuuauccuuagcaagcgggauuucguucaccuguuucucgacgauauucuguucuaccaaagaccucuucgcucucagaaguccgccaucggggacuguauucuggaauuuaaaacguacaaggacaaagauggaaacaauaucaaggaguaucucaaagugauuagcaaguccaacccccuguaccaggaguuccggaucuggcaguggcuguauaaucucaagaucuacagaaaagaagacgaugaggacgugacacugcaauuuauugcuaacaucgaagauaaggagcagcuuuucgacuuucugucuaaucggaaaagcauugaacagaagccucuccuggaguaucugaucaaagccaagggccuuaaaaagcaggucaagaccgaggcuuaccgcuggaacuauguggaagauaaaauuuaccccugcuccgagacaaagaccaugaucagcaccagacucgccaaaguugaaaauauuccggacaacuucuuuacaaaggagaucgaacaaaaacuguggcauaucauuuacucugugacggauaagaaugaguucgaaaaggcgcugcggaccuuugccaaaaaguaugaccucgauaucgcuuccuucgucgacaacuucaaaaagauuccucccuuuaaaaaugaguacgggagcuucucugagaaggccaucaagaaacugcuuccucugaugagacucggaaaguauuggaaauggaacgauauugacaauaacacacagaaucgcaucagcaagaucauuaccggcgaauacgacgaggaaaucaaagauauugugcgggagaaguccaucgcucugacaaacgagaacgacuuucaggggcugcagcuuuggcucgcccaauaucugguuuacggaagacacucugaagccgauauugcuggcaaguggcacagcguggcggaccuggagaaauaucucaaugaguucaagcagcauucccugcgcaaccccaucgucgaacagaucauuaccgaaacgcuuagagugguccgggauaucuggcgcaaauacggccagggggccgagaauuucuucagcgagauucacguggaacugggaagagacaugaagaacacagcugaugagcggaaaaagaucguuaauguggucaccgaaaacgagaauaccaaccuccgcauuaaagcccugcugauggaacuuaagaauaacucugacggcaagcucgagguggagaauguuagacccuacuccccuacacaacaggauauccugaaaaucuaugaagaguacgccauuagcaccgggcuggacaacgaaaaggaugagaaagugaaggaagacaucaaaaagauuucucgggucgcucagccgacaacgaccgagcuccaacgcuauaagcuguggcuugagcagaaauacuguucccccuauacaggaaaggugaucccucugggcaaacucuuuaccgaagaguaccagauugaacauaucauucccaagagcagauauuacgaugacuccuucucuaauaaagugaucugcgaggccgcgguuaacaagcugaaggacaaaugucuggggcuugaguuuaucaagaauuaccacggccagauugucgaaacaggauucggccaaaaagugaccaucuuugaugaggaggcuuaucagaacuucgugaagcagcacuacgccuauaaccggagcaaacgcacgaagcuccugcuggaagaaauuccugagaagaugaucgagagacagaugaaugacacccgguacauuuccaaauuuguccucccccugcuuucuaaccuggugagagccgaagagaaugauaacgggguuaauagcaagaacgugcucccggucaauggaaaaaucacaaccaugcugaagcaagacuggggccugaacgauguguggaaugaccuuauccugccucgcuucguucggaugaacgaacucgcuaaaacaauugccuucaccuccuggaaugagcagcaucagaaguaucugcccacggugccucucgaacugagcaagggguuucagaaaaagagaaucgaucaccgccaucacgcuauggacgcccuugucauugcgugcgccacacgggaucaugugaaccugcucaauaacaaacacgcuaauaccgacacaaucagauacgaucugcaacgcaagcugcggcuuuucgagagaguuaccuauauugacccccagaccaaaaacaacgugacaaaggacaucccuaaagaguuuaagaagcccugggauaauuucacggucgacgcccgcaacgaacuggagaaaaucauugugucuuuuaagcagaaucuccggaucauuaacaaagcuaccaauaucuacacaaaguacgaaaacggcaaaaagauuaaggugggacaaaaagggcugaauugggccaucagaaagccgcuccacaaagagaccgucuucgcgaagguuucccugcggaaacgcaagacagugagacuuagcgaagcccugaaggauuggaaaaagauuguggacaaaaagcucaaacaggagaucaagcggcugaccugucaguauggcaaguuugaugucgacacgauccugcgcuacuucaaagauagaaaguaucaguuuggagagguggacguuucuaaagugaagauguacuauuucgaugaagagaacgcugccguccggaaaaauguggacacauccuuuaccgaaaaguucauucaaggcagcguuaccgauacagggauccagaaaauucuucugaaccaucucgaggcuaagggaaauaagguggagaucgccuucucuccugaaggcauugaggaaaugaacaaaaauaucauccagcugaacgaggggaagcuccaucugcccauuuuuaaagucagaguguacgaaaccaucggaaauaaguucagcguuggcgugaaagggaacaagaaggacaaauaugucgaggccgcuaagggcacaaaucuguuuuucgcgauuuacguggaugagaacggaauccgcuccuacgaaacgauuccccuuaacaucgugaucgagcggcugaaacagggccucagcgucguuccugaaaagaauagaaaagagcacucucugcuguuuuaucuuuccccgaacgaccucguguacgugcccauugaagacgagcgcgagaauauccacgccgucaaccuggaucaacucaauaacgaacagcggaagagaauuuauaagauggugagcugcaccggguccgagugucacuucguuccuuacuauguggcuucucccaucgucaauaaaguggaauacagcucccugaacaagauuggacgcucucuuacaggcgagaugaucaaagacguuugcauuaagcugaaaguggaucggcuggggaaugucaagggaaucagcggccucuga

SEQ ID NO: 4591 - RNA, 4536 nt, Artificial Sequence
  Cas9 variant
augaagaaaauccugggccucgaccuggggaccaacagcauuggaugggccgugaucaauuccgucgcugaugagucuguugaaaagagaaacauugagcuugccggcagccggaucauucccauggacgcggcugugcuggggaauuucgauaacggagugacaaaaucccagacggccgaacgcaccucuuacagaagcauccggcgccucagagagcggcaacugcuucgcagagaacggcugcacaagguccuccagauccugggcuuucugccugagcauuaugugaaugacauugauuucgagaaccacccggggaaaaucaagaagaauacagaacccaaacucccuuggcgcaagaacuccaugggacaguuugaguucauuuuucaggccucuuucgaagcuaugcugaccgacuuugccacacaucaacccguuuucgugagcgagggcaaaaagguccacuacgauuggacccuuuauuaccugcggaaaaaggcucucacagaggaaaucuccaaggaggaacuggccuggauuauccuuaauuuuaaccagaaaagaggcuauuaccagcugcgcggggaggaagaggaggaacagagcaauaagcucguggaguucuaugcgcugagaguugugaaagucgaagccaccgacgauaagaaaggaaaggacacgugguacaacgugcaucuggagaauggcuggauuuaccggcgcaccucuaacaucccucucgauugggaagggaaagugaaggaguuuaucgucacaaccgaccugaaugaggauggaacacccaaacuugacaaauauggcgaaguuaagagauccuuccgggcuccuaaagaggacgauuggacccugauuaagaaaaagacggaaagcgacaucgccaacucucacaagacacucgggugcuacauuuaugaugcucugcuucaaaacccgaaucagaaaaucaagggaagacuggugcgcaccguggagcggaaauuuuacaaggaggagcucagacugauucuggagaaacagcucuccuuccaccccgaacugcaggaccgcgaucuuuaucgggccuguaucgacgcgcuguacgucagcaacgaggcccauaagaauaacaucucuggcagagauuucguguaucucuuuauugacgauaucauuuucuaccaacgcccucugaagaccaaaaagucccuuaucgacaauugccccuacgagaaaaaccaguauauggaucgggagacaggcgagguuaagcaggcuccuauuaaauguaucgccaagagccacccccuguuucaagaguucagacucuggcaguuuaucuccaauauucgcaucuaccagcgggaaagagugauggacgacgggaagcuggaaaccgaugucgacgugacaccggauuuccugaaaacggaggacgauuauaccacacucuuugaauggcugaacgaccgcaaggagguugaucagaaggcuuuccuuaagaauccucaauuuggacugaaaaagaccuucacagaguaccgguggaacuauguggaagacaaaucuuaccccugcaaugagaccagaaacgccauucucaauggccugcagaaggccggggucagcgcugauuuucugucccgggaaguggaggaagcgcuuuggcauauccucuauagcgucgaggacaagauugagaucgaaucugcccugcgcaaauucgcuuccaagcacgaucuggacgauagauuugccgacguguucaaaaagcucccucccuuccggaaagaguacggagccuacagcgcuaaggccauuaagaaacugcuuccccugaugagaaugggcaaguauugggaacucucuaacaucgacgauaaaacgaaggagcgcaucgacaaaauuaucacaggggaaugggaugagaauauucacaaccggguuagagagaaggcgaucaagcugagcgacauuaccgauuuuaaaggacugccucuuuggcucuccuguuacguggucuauaaccgccauucugaagcuagagccaucgccaagugggagagcccggaagacaucgauuccuaccugcggcuguuccgccagcacagccucagaaaucccgugguugaacaggugauuaccgagacacugcggaccguccgcgacaucuggaaaagaauuggccaaaucgaugaaauucauguggagcuuggccgggaaaucaagaacccugcugacaaacgcgccaagaugacagcucagaucguggagaaugaaaacacgaaucugagaauuaaggcccuccuggcggaguuuaucaacucugaguaugaaauugagaauguucggcccuacuccccugggcagcaggaaauccugcgcauuuaugaggauaccguccuuaacagcguggaagagauccccgaggacaucucugccgugcucaaaaaguucagagaauccgaucugaaaaagcggccgacaaaaagcgaguuucugagauacaagcucuggcuggaacaaaaauaccgcuccccuuauaccggagacauuaucccccuuggcaagcuguucacaucugcuuacgagauugaacacaucauuccucagagccgguauuuugacgauuccuucucuaauaaggucaucugcgaggccgaggugaacaaacucaagagcaaugaacugggguacgaguuuauuaaaaaccaucacggacaguauguugaaaucggcuucgggaaggugguccagaucuuuuccauugaggcuuacgagaaauucgugaaggccaauuauagcggcaucggaucuaagaugaaaagacugcuuauggacgauauucccgaaaccuuuaucgagcgccaacucaacgacucccgguacauuagcaagguugugaaaucucugcuguccaauaucgucagagaaaaggauagcaacggcgaguacgaaccugaggcgaucucuaaaaacgugauuguuuguacggggagcgugaccgaccgccucaagcgggauuggggagucaaugacguguggaacuccaucauuuaucccagauucgagcgccugaaugaacuuacaggcagccagcaguucgggugcugggagaacaaggaaggaaaacggguguuucaaaccgccgucccgcuggagaugcagaagggcuucucuaaaaagagaaucgaucaccggcaucacgcuauggacgccauuguuaucgcuugugccauccgcaaucauauuaacuaccucuccaaugaaagcgccuccaaaaaggcuaagaucucuagaauugaucugcagcggcugcuuugcacaaaaugucgcaccgacgacaacgggaauuauaaguggaucgugaaaaagccuuggcccgcguuuacgcaggauauuagaaaagcccuggagaacaucacagugagcuucaagcaaaaucuccgggucauuaacaagaccacaaauuacuaugugcacuuugacgaguccggcaaaaagguucuggaaaaacagaucaacggagauucuugggcuaucagaaagcccaugcacaaagacaccguguucggcaaggucaaucuccagaaagugaaggagguucgccugagccuugcccuggauaccccuaagaugauuguggacaaaaagcucaaagaaaagguccugcagcuguacuccuauaaauacgauaagaagcggaucgacaaauacuuuaaggagaacgccucucuuuggaaagaucugaaccucagcaagguggcuguuuauuacuucacaaaugacuccacggaaccgcugguggccgucagaaaaccccucgauaccagcuuuaacgcgaagaagauuaaagagucugugacagacaccgggauccaaaagauucugcuuaaucaucuguccaacaaucaggauaacccuaaucucgcuuucagccccgacggaaucgacgagaugaaccgcaaucugacaacccugaacgauggcaaauaucaccagccuaucuacaaggugcgggucugcgaaccccaggggaauaaauuuucuguuggaacguccggcaacaagacaagcaaguauguggaggccgccaaagggaccaaucuuuucuucgcuguguaccaaaccgaagacggcaagagaaacuaugagacaauuccucugaaugucgugaucgagcgcgaaaaacucgagugggcccccguuccggaaaacaauaacaacggagauaagcugcucuuuuggcugucuccuaaugaccuuguguacguccccaccgcggaugagcugaacaauggcaugcggcuggacaacauggauaaagggagaauuuacaagaugaucuccugcagcggaccucaguguuucuuuauuccccagaauguguccaacccgaucaucccuguuauugaacucggcgugaauaacaaagcugaaaagagcuggaauaacgagaugaucaaggucgugugcguccccauucgcguggacagacugggguguaucacacaaauuaauaaccagaaauga

SEQ ID NO: 4592 - RNA, 4539 nt, Artificial Sequence
  Cas9 variant
augaagaaaauccugggccucgaccuggggaccaacagcauuggaugggcccuuaucgaaaauuccuucacagaaaaggagggcaaaauuaacgauaugggggugagaaucauucccaugucugcugacauccugggaaaguuugaugccggccagagccacucccaaacggcggaacggaccggguaccgcggaacaagacggcucuaucagcgcgacaaucugagacgggagcgccuucauagaguccugcacauccucggcuuccugccuaaacauuacgaugaacacauugacuuugagaagcggcugggccaguucaaggaggggaaagaaaucaagcucaacuaucgcugcaauguugagaacaaacaugaauuuauuuucaucucuagcuuuaaugagaugcugaccgaguucaagaaagcucagccggaacuguuuuaccuuaaguccaacggagaggaaacaaagauucccuaugauuggacccucuacuaucugagaaagaaggcccuuucucaaccucugacaaaacaggagcucgccuggaucauucugaauuucaaccagaagcggggcuacuaccagcugcgcggggaagagaucgacgaugacaaaaauaagcaauuugugaaacucaaggugaaggaggucaucaacagcggagaagcugugaaaggcaagccccuguucgauguuauuuuugagaauggguggaaauaugacaaacagguggucaaaaccgaagauuggaucgacagaacgaaggaguucauugugaccacaaagguucuuaaaaacggagaccugaagcgguccuacaaaaccguggauagcgaaaaggacugggccgcuaucaaagccaagacagagcaggauauugagcgcucuaauaagaccgucggcgaguucaucuaugagacgcuccuggaaaacccuacacagaaaaucagaggcaaacuugugaaaaccauugagcggaaguuuuacaaagaggaacugaagaacauccucauuaagcaaaucgagcugcagcccacacuguucuccgaggaacucuauaaagcguguauugaggaacuguacccuagaaaugaggcccaccagaacgcuaucaagaaucgcgacuuuaucuaucuucugauggaugacauuaucuucuaccaacggccgcucaaaagccagaagucuaacauuuccgggugccagcuggaacagagaguguacuauaaagccaauaaggauagcggagagaacgaagaggucaaacaagcuguuaaggccauccccaagucucacccucuuuuucaggaguuccgcaauuggcaguggcugcagaaccucaaaauuuacaauaagguggacaccgaaaaaggcgagcugaccgaugugacaaagcaacugcuccccuccgaagacagcugggucaaccuguuuaauuuccuucaguguaaaaaggagcuggaacagaagcaguuuaucaaauauuucauugauaagaaacucaucaacaagacggagaaagaccauuaccgguggaauuauguggaagacaagaaguacccuuuuaccgagacaagagcgcaauucaucucccgccugaccaaaguugaggggauugaagagaucaacacauuucuggauaagaaaacccagauuggaacgaaggacaauucucccuucgugagccggaucgaacagcuuuggcacauuaucuauuccgucagcgauaucaaagaguacgaaucugcccucgagaaguucgcuauuaagcaucaccugaacgaggaauccuuuguggccaacuucaucaaauuuccgccuuucaagagcgacuacggcucuuauagcaaaaaggcucugaauaaacuccugccccuuaugagacgcgggaacuacuggacagagaaugauauuuccgaaaagguuaaacugcgggugucugagaucauggagagagucaacgcccucaaucugaaggaagacuauagcuccaaggagcuggccgaaacccuugugaacgucagcgaugacgaugugaaaaagcagcucauuaaaucuuuuguuuccuucaaggaccgcaauccucugaugggacugaacaccuuucaagcuacauaccucguguauggccggcacagcgaggucggcgauauccagaauuggaaaacccccgacgauaucgacacauaccugaagaacuucaagcagcauucucuuagaaaucccauuguggaacaaguugugacggagacccugcgggucgugcgcgacaucuggaaacaccaugggaagucccagacaaacuuuuucaaugagauucacguggaacucggaagagagaugaaaaacccugcggauaagcggaaaagaaucagcgaacgcaauaccgagaacgaaaacacaaauaaccggauuagagagauccugaaggaccugaugaaugaugccuccauccagggcgacguucgcgauuauucuccgagccagcaagggauucuuaagaucuacgaggaaggagucuaccagaaccccaaaguggacuauuccaaggugucugaggaugaaauuaccaaaaucagacggagcaauaacccuacgcagaaggagauucagcgcuacagacucuggcuggaacaaggcuauaucucccccuauaccugcaaaccuauuccccugagcaagcucuuuacacaucacuaccagaucgagcacaucauuccgcagucucgguacuucgacaauuccagcucuaacaagaucauuugugaguccgaagucaaugaggauaaagacaacaagaccgcuuuugaauaucugaaagauaagggggagaaugugaucaacggccauaaacuucugagccucgccgccuacgaggcucacguuaauaaguacuucaagaacaaucgccagaaacugaagaaccugcuuucugaagacauuccugagggauucaucaacagacaaaugaaugauagccgguauaucuccaaacucgugaagggccugcugagcaacauuguccgcgaagagggggaacaggaggugacaucuaaaaaucucauccccguuaccggauccgugacgagcaagcugaaaaacgacuggggccuuaaugacaaguggaacgagcugauucucccuagauuuaagcggcugaaucagcugacacaaaccaacgauuucacaaccgccaauaccaacgggaauacaauccccacggucccugacgaacuucugaaaggauuuuccaagaaacgcauugaucauagacaccacgcgcucgacgcucuggugguugccugcuguacccggaaccauucuaauuaccucagcgcccugaacacagagaauaagaacuauggccuuagagauaaacugcucaucaagaaugacaacgaucacuacaccaaguccuuccagaugcccuggcauggguuuacaaccgaagcuaaaaaccagcuggaggaaacggugaucucuuucaagcagaaucugcgcgucauuaacaaagccaauaacaaguuuuggagcuauaaagacgagaauggcaaacuuaaccuggauaagaauggaaaaccgaucaagaaacuccggaagcaaacaaaaggcgacaacugggcugugagacagccucugcacgaggaaaccauuuccgggaucgugaaucuccccugggucaaggccgagaaggaaaaauucaccuacgcgacacgcaagucucuggauaagagcuuugaccuuaagaaaauugagaagaucaccgacacaggcauucagaaaauccugcggaacuaucucaugcaggaaaaguucaaggagcuggauaaaaaggacaaagagguuuacaauuccgaacuggccuuuagccaagagggacuugaagaucugaacucuaauaucgagcaguucaacgaccagaagccccauaaaccuauuuacaaggugagacucuucgagaagggguccggacgcuuugcucugggcuucaaagggaucaaugccaagaaauaugcucagggcagcccgaaccucuacuuuaacauuuaucggaaugaagauggacaauacuaugagacggugccccugaacaaggucaucauucaccagaaaaaugccgcgaacaugccuaagaagaauagaacccccgugccuaucucuaacacagccaucaaucgcuccaaagaaguucuuguggacuacaagaugacccugagcccccuggaucucgucuauauuccuacagaggaggaacugaacaauaucaacucucuugacuucaauaaccuguccaaaagccagcggaagagacucuacaaugugaacgauuuuuccggcuacaccauuuauuucagccccaauacgcuggcuaaaucuaucugcccgaaggagguugacaugaaguuugaugaaaagaagcagaaaccuaccgggagcuucgacuccaagacagccucucucgauggaaugagcauuaaagagcgguguaucaagcugaucauugaccgccuuggcaacaucuccaaagcuuga

SEQ ID NO: 4593 - RNA, 4539 nt, Artificial Sequence
  Cas9 variant
augaagaaaauccugggccucgaccuggggaccaacagcauuggaugggccguggucaaugcugaugagaucacaagagacgauggcucccgguaccuuaagcccaacgggauuucugccgcgggaagccgcaucauuccuauguccgcugacauccugggcgauuucgaaaaagggaauagcaucagccagacggccgagagaacccggaugcgcauggccagacggcuccacgaacgcgcucugcuuagacgggagcgccugcucagaguucugaaccugcucgacuuucugccgaagcauuucgccgauaaaauugaccgguauggaaaguuuacagaugacuccgaacccaagcuggcuuggcgcaaaaauaccgagggcaaguacgaguucaucuuucaagaugccuucaacgaaaugcuggcggaguuuaaagacaagcagccugaaauuguggaggagggcaaaaagauccccuaugauuggacaauuuacuaucucagaaagaaagcccuggaaaaggcucuuucuaaagaggaacugagcuggauccuccugcaguucaaucagaagcggggguacuaucaacugcgcggagaggaagaggagauuccucaggacaaaaagaucgaauaccucgcccagaaaguggucaagguggaggcuaccgaccagaagaaaggcgaugacguuugguacaacguguaucuggaaaaugggaugaucuacagacggacauccaaggcgccccuugauugggagggaaaagucaaggaauuuauugugaccacggagguugagaacgacggcgaaaccccuaaaaaggauaaggaggggaauaucaaaagaucuuuccgcgccccgaaggaagacgauuggacacugcucaaaaagaaaaccgaggccgacauugaaaacucucacaagacagugggaugcuauaucuacgauucccugcuuaauaaccccaagcagaaaauuaucggcaagcugguccggaccguggagagaaaauuuuauaaggaggaacucacgcagauccugaaaaagcaaguggagcugauuccugaacuccgcgacgauaaucuguacaagcaguguaucgaggagcuuuaucccauuaacgaagcucaucggaacacaaucgccaaaaccgacuucgcuaaucuguuuauuaacgacauccucuucuaccaaagaccucuuaagagcaaaaagucucagaucgauaauugccccuacgaggaacgcauuuucaucgacuccaaaacaggcgagaagaaaaaggucccgguuaaguguauugccaaaagcaacccucuuuuucaggaguuccggcuguggcaauuuauccagaaucucagaauuuaucagcgcgaaaaggagaucgaugggaaacugcugaccgacauugauaucaccucugaaugccucaaguccgaggaagacuacgugcggcuguucgauuggcuuaacgacagagagacaaucgaacaggaggaucugcucaaacaccuguuuaauacgaaaaagagcaagaacaaggagaaucccuaucgcuggaacuacguggaagacaaagucuauccuuguaaugagacccgggccacaauucugaagggauucuccaaaugcggcaucaacgcuucugugcuuagccccgaacucgagauggcgcuguggcauauucuguacuccguugaagauaagaaggagaucgagaccgcccucacacacuuugcucaaaaacagggguggaaugacgauuucgccaagguguuuagcaaagccaagcccuucaaaaaggacuauggaucuuacuccgaaaaggcuauuaaaaagcugcuuagccugaugagaaugggcaaauacuggaaccaggacaauaucgauaagaacacccucgaccggaucgauaaaauuaucaacggggaguaugacgaaaagauuucuaaucgcgucagagauaacgccaucaaucugaaagacauuagcgauuuucggggacugccuguguggcuugcguguuacaucguuuaugacagacacuccgaggcuaaggauugcacgaaguggaacucuccggaggaaaucgacagcuaccucaaaaaguucaaacagcauucccugcgcaaucccauuguggagcaagucgugacagaaacccugcggaccgucagagauaucuggauucaggaggaacagaucgacgagauucaccucgagcugggccgcgaucuuaagaacccugccgacaaaagaaagaagaugagcgaaaauauccugaaaaacgagaauacaaaccuccggaucaaggccaugcugauggaauuuaugaaucccucuaugggcauugagaacgugcgcccuuauucccccagccagcaagacauccugagaauuuacgaagagaaugcucuugauaaccucaccaaagacgauaaggacuucgauuucaucucuaaaauuuccaagcaggcccagccgagcaagacagacaucauucgguauaaauguuggcuggagcagaaguaccgcuccccuuacacggggaaaaccaucucucugagcaagcucuuuacacccgcuuaugaaaucgagcauguuauuccucaaucccuguacuucgaugacucuuuuagcaauaaagugaucugcgaagccgaggucaacaaacuuaaggauagacagcugggauauaaguucauugcggaacaccacggcgagaaggugcagcucucccaaggggagguuguggaaauccugagcgucgacgccuacgagaaauuugugaaggaaaacuaugcuaauaaccggauuaaaaugaagaagcugcuuauggagucuauccccgaugaguucaucgaacgccagcucaaugacuccagauacauuagcaaagugguuaagggacugcugucuaacaucguccgggagaaaauugacgaugaaaauuaugagccugaagccguguccaagaaccucaucagcuguaauggcgcuauuaccgaccgccugaaaaaggauugggggaugaacgacguguggaacucuaucauccuucccagauuuauucggaugaaucagaucacaggcaaagauugcuucaccacgaccaaugccgagggacaucugauuccgcagaugccucucgagcugcaaaagggcuuuaacaagaaaagaaucgaccaccgccaucacgcgauggaugccauugucaucgcuugcacaacccgggaccaugugaaucugcuuaacaaugaagccgcucacagcaaguucaacgccacaagauaccagcugcagcgcaaacuccggagauuugagaaggccguuauugaugggaaagaacgcgagguggcuaaggaguuccugaagcccugggacuccuuuagcucugauuccaaaaacauccucgaaaauaucauugucagcuucaagcagaaccaacgggugaucaauaaaaccacgaacgcguuccugcacuuugacgagaauggaaagaaaacauucauuaagcagggcaagggggauuccugggccaucagaaaaucuaugcauaaggacaccguuuuuggagaaauuaaccuucgcaaagugcggagcgucucccugaaugaggcuaucaaggugcccgaaagaguucucaacaaaaagaucaaggagaaaauucuggaacugaagaauaacaaaaucgacgccaagaauauuaaaaaguacaucgaggagaaccacacaggcggguauggcauugauucuagcaaaaucgacguguucuacuuuaccaaggaaaccaaggagcgguucuuugccacacgcaaaacgcuugauaccuccuucaaucaggcuaagaucaaagacucuauugccgauagcggaauccagaagauucugcucgcgcaucugaaauccaagaacggcgacgcugaacaagccuuuagcccugaugggaucgacgagaugaauaagaacauugucgagcucaauaacggaaaauuccaccagccgauccugaaggugagaguguaugaaaaagccgauaaguuugcugucggccagaaagggaacaagaagguuaaauucguggaggccgcgaagggaacaaaucuuuucuuugcuauuuucgaaaaagacggcaagcggucuuaccugaccaucccccucaacgugaugaucgauugucaaaaacaguaugggaaucaguggaagaacaauauugaggccuaccugaaggaaaaagagcuggucgagaaggacgugaaacuucaguuuauccuguccccuaacgaucucguuuaucugcccacagaaggcagcauugacaagaaacgcaucuacaagguggucucuuucaccaauaacagacucuacgccauuccuuaugcuaucgccaaauccaucguggacaagaaugaguuuacgcaacugaacaagauugaguucacagauaauaaagaaagcaucaaggacgcuugcguucccgugauuaucgaucggcuuggaaacgucauugaauuuaauggcaaaagacuguga

SEQ ID NO: 4594 - RNA, 4539 nt, Artificial Sequence
  Cas9 variant
augaagaacauccugggccucgaccuggggaccaauagcauuggaugggccgugaucaacuccgaggaagauggccccauugucaaaaagagaaucgagcuugcugggucucggauuaucccuauggacgccgcgguucugggaaauuucgauagcggcgugacaaaaucccagacggcugaacgcaccucuuuuagaagcauccggcgccucagagagcggcaacugcuucgcagagaacggcugcacaaggugcuccagauucugggguuccugccggagcauuacgucaacgacaucgauuuugagaaucaccccggaaaaauuaagcgcaacacagaaccuaagcuccccuggcggaaaaauuccaugggccaguucgaguuuaucuuccaggacucuuuugaagccaugcugaccgauuucgccacacaucaaccuguguuuguuagcgagggcaagaaagugcccuaugacuggacccuuuacuaucugagaaagaaagcucucacagaggggauuuccaaggaggaacuggccuggcuuauccugaacuucaaucagaagcgcggauacuaucagcucagaggcgaagaggaagaggagcagagcaacaaacuggucgaauuuuacgcucugcgggugguuaagguggaggccaccgaugacaaaaaggggaaagauacgugguauaauguccaccucgaaaacggauggauuuaccgcagaaccucuaauaucccucuggacugggagggcaaggugaaagaauuuaucgugacaaccgaucuuaacgaggacgggacaccgaagcuggacaaguacggagaggucaaacgguccuuuagagcgcccaaggaagaugacuggacccucauuaaaaagaaaacggagagcgauaucgccaauucucauaagacaguuggcugcuauauuuacgacgcucugcuucaaaacccucaccagaagaucaaaggccgccuggugcggaccguggaaagaaaguucuauaaagaggaacuccgccugauucuggagaagcagcucuccuuccaccccgagcugcaggaucgggaccuuuacagagccuguaucgaugcucuguaugucagcaacgaagcccauaaaaauaacaucucugggcgcgacuuuguguaccucuucauugaugacaucauuuucuaucaacggccucugaagacaaagaaaucccuuaucgauaauugccccuacgaggaaaaccaguacauggacagagagaccggagagguuaagcaggcgccgauuaaauguaucgccaagagccacccucuguuccaagaauuucgccucuggcaguucaucuccaauauucggaucuaucagagagagcgcgugcuggacgauggcaaacuggaaaccgacgucgaugugacacccgacuuucucaagacggaggaugacuacaccacacuguucgaaugguuuaacgaucggaaggagguugaccagaaggcuuuccuuaaaaauccucaauuugggcugaaaaagaccuucacagaguauagauggaacuacguggaagauaaaucuuaucccugcaaugagacccggaacgccauucucaauggacugcagaaggcuggcgucagcgccgacuuucugucccgcgaaguggaggaagcccuuuggcauauccucuacagcgucgaggauaaaauugagaucgaaucugcucugagaaaguucgcguccaagcacgaccuggaugaccgguucgccgacguguuuaaaaagcucccucccuucaaaaaggaguauggggcuuacagcgccaaagccauuaagaagcugcuuccgcugaugagaaucggaaaauacugggaacucucuaacaucgaugacaagacgaaagagcgcauugauaagaucauuacaggcgaaugggacgagaauauccacgaucggguuagagagaaagcuauuaagcugagcgacaucaccgauuuuaagggccugccccuuuggcucuccuguuauguggucuacaaccgccauucugaagccagagcgaucgcuaaaugggagagcccugaagacauugauuccuaucugcggcuguuccgccagcacagccucagaaaucccaucguggagcagguuauuaccgagacacugcggaccgugcgcgacaucuggaagagagucgggcaaauugaugaaauccauguggagcuuggacgggaaaucaaaaacccugccgacaagcgcgccaaaaugacagcucagauuguggagaacgaaaauacgaaccugagaaucaaggcccuccuggcugaguuuauuaauucugaguacgaaaucgagaacguucggcccuauuccagcaaucagcaggaaaagcugaaaauuuacgaggauaccguccuuaacggcgugaaggaaaucccggaggacaucaauacaauucucaaaaaguuccgcgagucugaccugaaaaagagaccuaccaaauccgauuuucugcacuauaagcucuggcuggaacaaaaguacugcagccccuacacagggcggaucauuccucuuggaaaacuguucaccuccgccuaugagaucgaacauauuaucccccaggcgcacuacuuugacgauucuuucagcaacaaggugauuugugaggccgaagucaauggccucaaagacaagaaacugggguaugaguuuaucaagcacaacccuggcaagaugguggagaucggauucggcaaacccccgguuagaaucuuuuccguggaagaguacgaacgcuucgucaaggagaauuauucugggauuaaaaacaagaugaauaaacugcuuauggaugacauuccugagacguucaucgaacggcagcucaacgauagcagauacauuuccaaggugguuaagagccugcugucuaauaucgugcgcgagaaagacuccaacggagaauaugagcccgaagcuaucagcaagaacgucauugugugcaccggcucuguuacagaucggcucaaaagagacuggggagugaaugaugucuggaacuccaucauuuacccccgcuuugagcggcugaaugagcuuaccgggagccagcaauucggcuguugggaaaacaaggaggggaaaagaguguuucagacagccgugccucuggaaaugcagaagggcuucucuaagaaacgcaucgaccaucggcaccaugcuauggacgccauugucaucgcgugcgccaccagaaaucacaucaacuaccucagcaaugaguccgcuagcaagaaagccaagauuucucggacggaucugcaacgccugcuuuguacaaaaugcagaaccgacgauaacggaaauuauaaguggaucguuaagaaaccguggcccgcuuuuacacaggacauucggaaggcccuggaaaacaucaccguguccuucaaacagaaucuccgcgugauuaacaagaccacaaauuacuauguccacuuugaugagagcggcaaaaaggugcuggagaaacagaucaacggggacuccugggccauuagaaagccuaugcauaaggauacgguuuucggaaaagugaaucuccaaaaggucaaagaagugcggcugucucuugcucuggacacccccaagaugaucguugauaaaaagcucaaggagaaagugcugcagcuguacagcuauaaguacgacaaaaagagaaucgauaaauauuuuaaggaaaacgcgucccuuuggaaggaccugaaccucucuaaagucgccguguacuacuucacaaaugauagcaccgagccucugguugcugugcgcaagccccucgacacauccuuuaacgccaaaaagauuaaagaaucugucaccgacacgggcauccagaagauucugcuuaaucaccugagcaacaaucaggaugacccuaaccucgccuucucccccgaugggaucgacaagaugaauaaaaaccugacagcucugaaugauggaaaguaucaucaaccgauuuacaaagugcgggugugcgagccucagggcaacaaguucagcgucgggaccucuggcaauaaaaccuccaaguauguugaggccgcgaaaggaacaaaccuguuuuucgcuguguaccagaccgaagacggcaagagaagcuaugagacaaucccccuuaauguggucaucgaacgcgagaagcucggguggacgccugugcccgagaacaauaacaauggagauaaacugcucuuuuggcugucuccgaacgaccuuguuuacgugccuaccgccgaugaacugaacaauggcaugcggcuggacaacauggauaaggggagaauuuauaaaaugaucuccuguagcggaccccagugcuucuuuauuccucaaaaugucucuaacgccaucauucccgugaucgagcucggcgcuaauaacaaggccgaaaaauccuggaauaacgagaugaucaagguuguguguguccccauucgcguggaccggcuggggugcaucacacagauuaauaaccagaaguga

SEQ ID NO: 4595 - RNA, 4551 nt, Artificial Sequence
  Cas9 variant
augaagaacauccugggccucgaccuggggaccaauagcauuggaugguccgugauccaggagaaacacaacgaaaauaacgagugccaaaaacuuauucugggcgccgggucuagaaucauucccauggaugcugccguccucggagacuucgcgaaaggcaauacaaucagccagacgaaggaucggacccaguaccgcgggguuagacggcugcgcgaaagaugucuucugcggcgcgagagacucuuucgggugcuggacaucaugggauuccugccucagcauuuuuccaacgcucucacacgcuauggcaaauucaaggaugccgacgaggaaccgaagauugccuggagaaaagaugacgagggcaagaugcacuuucuguucgcugauucuuuuaaugaaaugaucgaggaguuccggagcgugcaacccgaacuucugaaacgcgggaugaaggucccuuacgacuggacccucuauuaccugcggaaaaaggccaugcgggaggcugugacacccuuugaacuugccuggcugauucucuccuucaaccagaagcgcggauauuaccagcugagaggcgaggaagagggggaagcggauaauucuaaaagcgaggaguaucuggcccagcggguuguggacgucaucgauaccggagaaaagaaaggcaaguccacaugguuugacauugugcucgagaacgggaugguuuaccauagaccugcugaaaucaaacccgacuggauuggaaagaccaaagaguucaucgugacgacccaauuugauaaggacggcaauccuaagaaagauaaggaaggcaacgucaaaaugagcuuccgcaugccgaaugagaacgacuggaaucugcagaagaaaaaggccgagaaggauaucgacgaaucugggaugacagugggagaguacauuuauaacgcccuucugcacaaccccaaacagaagaucaaaggcaagcucgugcgggucguugaaagaaaauacuauaagaaugagcugcagaagauucuugaaucccaaaaacgcuucaucccucagcugagcgauucugcucucuacgagaagugcauuaaagagcuguaucaguccaacgaagcguaccggaauagcaucucuaccagaaacgacuuuacauaucuguucguggauaauaucaucuuuuaccaacgcccccucaaguccaaaaagagccugauugacaacuguccuuacgagucccuugccuauaccaaggauggggaggaacauaaagcucccgugaagugcauugccaaaucucacccgcuguaccaggaguuccggcucuggcaguuuaucagcaaucugagaauuuaucagcgccaaaagcaggucggagacaaagugaaacuugacguugaugugacggacgaguuccugccuacagaugaccggagagaaucccucuuugauuaccugaacgacaaaaccgaaaucaagcaggauguccugcucaaggaguucuuuagcaugaaaaagcccaaaggcaaggacucuguguauccuuaccgcuggaauuauguugaagauaaauccuaccccuguaacgugacacgggggaagauccuggcuaaacuuaauagagccggaauuagcgccgacuuccugucuagcaacggcaaugaggagucccucuggcacauccuguacucugucgaagauaagggcgagcugcggaaggcucuugcgcgcuuugccgcuaaaaacgggcucgacgaugccuucaccgaagcccuggcugacauugagcccuauaagaaagaauacggagccuauagcgcgaaggcucugaagaaacuccugccucuuaugagacugggcaaguacuggaauuaugacaacaucgccccggccaccaaagcucggauuuccaagaucauugauggggaguacgacgagaacaucagaaaucgcgugcgggaaaaagccaugagccucaacucugcuucccaguuucaaggacugccccuguggcuugccugcuauaucgucuacgauagacauagcgagcgcgcggacucuggcagaugguccagcccugaagauauugacaaguaccucuccgauuucaagcagcacucucugcggaaucccaucguggagcagguugugacagaaacgcugcgcaccgucagagacauuuggaaacgguauggggagaucagcgagauucauguggaacucggccgcgagaugaagaacccugccgauaaaagauccaagaugaaucggcgcaugcuggaaaacgagaaugcuaacaugagagccaaacuucugcucacagaguucaugaaucccgaauuuggaaucgagaacguucggucuuacagcccgucccagcaagaacugcugcgcaucuaugaggacggcgcuauuagcaaugccgggucugaaaucgaugacgagauuuccgauaucaugagcagacuuucucagguggacgucaagaaacagccuaccgcguccgaggugaagcgguacauucucuggcuggaacagaacuauagaagccccuacacaggacaaaugaucccucuggccaaacucuucacccccgcuuaugagaucgaacacgugauuccucagucucgcuacuuugacgauagcuucuccaauaagguuaucugugaggccgaagucaacaagcugaaagaccggaugcuuggcuacgaguuuauuaagcagcacaaaggggagaaggugagccugucuaugggaggcacgguggaaauccucucccccgaggaauaugucagacauguggagagccaauacaagaauaacaaagcuaagaugcgcaaacugcugauggaugacauuccggaugaguucaucaaccggcagcuuaaugacuccagauauaucucuaagcucauuaucagccugcuguccaacauuguucgcgaagagggggaagaggaagccacaucuaaaaaugugaucagcugcaacggcuccauuaccgaucggcucaagaaggacuggggaaucaaugaugucuggaaccacauuauccugccuagauuucgccggcuuaaugagcugaccggcacagacaaauucaccacaucuaacaaggaggggcaugaagugcccgagaugccccucgaacugcagaaaggauuuaauaagaaaagaaucgaucaccggcaucacgccauggacgcuauuguuaucgcguguauuacgcgcgaccacgugaaccugcuuaauaacgaggccgcuaugagcaagaauaacgccaauagaauccagcuguccaagaaacuccggcgcuacgaaagcgucgagauugagaaggauggcaucagaaaacaaaucucuauggccaaggaguucaaaaagccuugggaaggguuuaccgcugacguggaacggacacugagagauauuguuguguccuucaagcagaaccuccgcgucaucaacaaaaccacaaauuauuaccagcauuuuaaggacggaaagaagauuuauagcccgcagucuaaaggcgauuccugggccaucagaaagagcaugcacaaagagaccguguucggggaaauuaacaucagacgcaucaaggaggugucucugaaggaggcgaugaaacggauuaaggacaucgcugauaaagaacuuagauccaagauugucgagcugauggcccuccaauacaaugaaaagaagaucaagcaguacuucagcgacaacaaagaugagugguccgacguuaaucccaagaaaauuaagauccauuauuuuacgaaagaaaccaacgagcgcuucuuugccacacggaagccucuggauaccagcuucgacaagaaaaagauuaaaacacagguggcugauaccgccauccagaagauccugcuuaaucaccugucugcgcacggcgacaaagcugagacggccuuuagccccgacggaauugaugaaaugaacagaaauaucauugagcucaacgacggcaaguuccaucaaccuauccugaaggugcgcauuuacgaaaaagccgauaaguaugcugucgggcagcagggaaauaaaaagaaaaaguacguggaggccgcuaaaggcacaaaccucuuuuucgccaucuaugcggaggaaaagaucgacgagaagaccggggauacaguuauuaccagaaccuacgacuccaucccccugaauguggucauugaucgggaaaaacgcggacuuucuccugugcccgagaacgaaaauggcgccaagccgaaauauguucugagcccuaacgaccucguguacguccccaaugaggaggaaagagagacagggcggaucugcgaaccucuggauaaggagcgcauuuacaaaaugguguccucuaacaagaagcaagccuuuuucaucaaaagcgaaguugcuuccacgaucguggacaaguuugaguucucugcucugaacaaacaggagagagcccuuagcggcgaaaugauuaaggagaucuguauucccaucuccauuaaucggaucggagaaauuacccugagauga

SEQ ID NO: 4596 - RNA, 4554 nt, Artificial Sequence
  Cas9 variant
augaagaaaaucgugggccuggaccucgggaccaacagcauuggaugggcccugaucaaugcuuacauuaacaaggagcaccuuuauggcaucgaagccugcggguccagaauuauccccauggaugcggcuauccugggaaauuucgacaaaggcaacucuauuagccagacagccgaucggacguccuaccgcgggaucagacggcuccgcgagagacaucugcuucggcgcgaaagacugcaccggauucucgaccugcugggauuucucccuaagcauuauucugauagccugaaucgcuacggcaaauuccuuaacgacaucgaguguaagcugccgugggucaaggaugaaaccggcuccuauaaauuuauuuuccaagagucuuuuaaggagaugcucgccaauuucacagaacaccaucccauccugauugcuaacaauaaaaagguuccuuacgacuggaccaucuauuaccuucggaaaaaggcccugacacagaagaucagcaaagaggaacucgcuuggauucugcugaacuuuaaucagaagagaggguacuaucagcuccgcggagaggaggaagagacccccaacaaacugguggaauacuauucccuuaagguggagaaagucgaagauagcggcgagagaaaggggaaagacacaugguacaaugugcaccuggagaacggaaugaucuaucggcgcaccucuaauauuccucucgauugggaaggcaagacgaaggaguucaucguuaccacagaccuggaagccgaugggucccccaaaaaggacaaagagggaaacauuaagagauccuuucgggcgccuaaagacgaugacuggacccuuaucaagaagaaaacagaagccgauaucgacaagauuaaaaugaccgugggcgcuuacaucuaugauacgcugcuccaaaagccggaccagaaaauuagaggcaagcugguccgcacaaucgagcggaaguacuacaaaaacgagcuguaucagauucucaagacccagucugaguuccacgaagaacugagagauaaacaacuuuacaucgccugccugaaugagcucuaucccaacaaugaaccucgccggaacuccaucagcacaagagacuuuugucaucuguucauugaggauaucauuuucuaccagcgcccccuuaagucuaaaaagucccugaucgacaauugcccuuaugaggaaaaccgguacauugauaaggagagcggggaaaucaaacacgcuuccauuaaguguaucgccaaaucucauccccucuaucaggaguucagacuguggcaguucaucgugaaucugcgcauuuaccggaaggagaccgacguugacgugacccaagaacuccugccgacagaggcggauuacgucacgcuuuuugaauggcugaacgagaaaaaggaaaucgaccagaaagccuucuuuaaguauccucccuucggauuuaagaaaaccacaagcaauuacagauggaacuauguggaggauaagccuuaccccugcaaugagacccacgcucagauuaucgcccgccucggcaaagcucacauucccaaggccuuccuguccaaagaaaaggaggaaacacuguggcauauccuuuauagcaucgaggacaagcaagaaauugagaaagcccuccacucuuuugcuaacaagaauaaccuguccgaggaguucaucgaacaguuuaaaaauuucccuccguuuaagaaagaauacgggagcuauucugcgaaggccauuaagaaacugcucccccugaugcggaugggaaaguacuggagcaucgagaacauugauaacggcaccagaauccggaucaauaaaauuaucgacggggaauacgaugagaacauucgcgagagagugcggcagaaggcuaucaaucuuacggacauuacacauuucagagcccugccucucuggcuggccuguuaucuggucuacgaucgccacuccgaaguuaaagacaucgugaaguggaagacccccaaagauaucgaccuuuaucucaagucuuuuaaacagcauagccugcggaacccuauuguggagcaagucaucaccgaaacacugagaaccgugcgcgauauuuggcagcagguuggacacaucgacgagauucacaucgagcucggcagagaaaugaagaaucccgcugacaaacgggcccgcaugucccagcaaaugauuaagaacgagaauacaaaccugagaaucaaagcgcuucugacggaauuucucaauccggaguucggcaucgaaaacgugcggccuuacagccccucucagcaggaucugcugcgcauuuaugaggaggggguccuuaauuccauccucgaacugccugaggacauuggaaucauucugggcaaguuuaaccagaccgauacacucaagagacccacccggagcgaaauccugcgcuacaaacuuuggcuggagcaaaaguauagaucuccuuacacaggggaaaugaucccccucuccaaacuguucaccccggcuuacgagauugagcauaucauuccucagagccgguauuuugacgauucccugucuaauaaggugaucugcgaaagcgagauuaacaaacuuaaggaccgcucccucggauacgaguucaucaagaaucaccauggcgaaaaaguugaacuggccuuugauaagcccguggagguccugucuguggaggccuaugaaaaacucguccacgagagcuacucccacaacagaagcaagaugaaaaagcugcuuauggaagacauccccgaucaguucauugagcggcagcugaacgacucuagauauaucuccaaggugguuaaaagccuccugucuaauauugugcgcgaggaaaacgagcaagaagcuaucuccaagaaugucauuccuuguaccgggggcaucacggaucggcugaaaaaggacuggggaauuaacgauguguggaauaaaaucguucuuccgagauuuauccgccugaacgagcucacagaaagcacccgguucacaucuauuaauaccaacaauacgaugauccccagcaugccucuggagcuccagaagggcuuuaacaagaaaagaauugaccaucgccaccaugccauggacgcuaucauuaucgccugcgcgaaucggaacaucgugaauuaccugaacaaugucuccgccagcaagaacacaaaaauuaccagacgcgaucuucagacacugcucugucacaaggacaaaaccgauaacaaugggaacuauaagugggugaucgacaagcccugggagaccuucacacaagauacgcugaccgcucugcagaaaauuacagugucuuuuaagcagaaucuucggguuaucaacaaaaccacaaaucauuaccagcacuacgaaaacggaaagaaaauugucuccaaucaaagcaagggcgacuccugggccaucagaaaaucuaugcacaaggagaccgugcauggggaagugaaccugcggaugaucaagacggucagcuucaaugaggcucucaaaaagccucaggccauuguggaaauggaucugaaaaagaaaauccucgcgaugcuggagcuuggauaugacacaaagcgcauuaagaacuacuuugaggaaaauaaagauaccuggcaggacaucaaccccuccaagauuaaaguuuauuacuucaccaaggagacaaaagauagauauuucgccgugcggaagccuaucgacaccucuuuugacaagaaaaagauuaaagaaagcaucacagauacgggcauccagcaaauuaugcugcgccaccucgagaccaaggacaaugaucccacacuggcuuucuccccggacgggaucgaugaaaugaacagaaauauucugauccuuaacaaaggcaagaagcaucagccuauuuacaaaguccggguguaugagaaggccgagaaauuuaccguuggacagaagggcaauaaaagaacaaaguucguggaagcugccaaagggaccaaccuguuuuucgccaucuacgagacggaagagaucgacaaggauaccaagaaagucauucgcaagcggucuuacagcacaaucccccucaacgugguuauugagagacagaaacaaggacuguccagcgcuccugaagacgagaauggcaaccuccccaaguauauccugucuccgaaugaucuuguguacgucccuacccaggaagagauuaacaaaggggaaguggugaugcccaucgaccgcgaucggaucuauaagauggucgacuccagcggaauuacagcgaauuuuaucccugccucuaccgcuaaccugauuuucgcccugcccaaggccacagcugagaucuacugcaauggcgagaacugcauucagaaugaauaugggaucggcagcccccaaagcaaaaaccagaaggccauuaccggagagaugguuaaagaaaucuguuuuccuaucaagguggauagacucggcaauauuauccagguggggucuugcauucugacgaacuga

SEQ ID NO: 4597 - RNA, 4563 nt, Artificial Sequence
  Cas9 variant
augaagaaaaucgugggccuggaccucgggaccaacagcauuggaugggcccugaucaaugcuuacauugaugaguauaacaaggaacaccuuuacggcaucgaggccugcggguccagaauuauccccauggacgcggcuauccugggaaauuucgauaaaggcaacucuauuagccagacagccgaccggacguccuaucgcgggaucagacggcuccgcgaaagacaucugcuucggcgcgagagacugcaccggauucucgaucugcugggauuucucccuaagcauuacucugacagccugaaucgcuauggcaaauuccuuaacgauaucgaauguaagcugccgugggucaaggacgagaccggcuccuacaaauuuauuuuccaagagucuuuuaaggaaaugcucgccaauuucacagagcaccaucccauccugauugcuaacaauaaaaagguuccuuaugauuggaccaucuacuaccuucggaaaaaggcccugacacagaagaucagcaaagaggaacucgcuuggauucugcugaacuuuaaucagaagagaggguauuaccagcuccgcggagaggaagaggaaacccccaacaaacugguggaguauuacucccuuaagguggaaaaagucgaggacagcggcgagagaaaggggaaagauacaugguauaaugugcaccuggaaaacggaaugaucuaccggcgcaccucuaauauuccucucgacugggagggcaagacgaaggaauuuaucguuaccacagaucuggaggccgacgggucccccaaaaaggacaaagaaggaaacauuaagagauccuuucgggcgccuaaagaugacgauuggacccuuaucaagaagaaaacagaggccgacaucgauaagauuaaaaugaccgugggcgcuuauaucuacgacacgcugcuccaaaagccggaucagaaaauuagaggcaagcugguccgcacaaucgagcggaaguacuauaaaaacgaacuguaccagauucucaagacccagucugaguuccacgaggaacugagagacaaacaacuuuauaucgccugccugaaugaacucuaccccaacaaugagccucgccggaacuccaucagcacaagagauuuuugucaucuguucauugaggacaucauuuucuaucagcgcccccuuaagucuaaaaagucccugaucgauaauugcccuuacgaagagaaccgguauauugacaaggaaagcggggagaucaaacacgcuuccauuaaguguaucgccaaaucucauccccucuaccaggaguucagacuguggcaguucaucgugaaucugcgcauuuaccggaaggaaaccgacguugaugugacccaagagcuccugccgacagaagcggacuaugucacgcuuuuugaguggcugaacgagaaaaaggaaaucgaucagaaagccuucuuuaaguacccucccuucggauuuaagaaaaccacaagcaauuauagauggaacuacguggaggacaagccuuaucccugcaaugaaacccacgcucagauuaucgcccgccucggcaaagcucacauucccaaggccuuccuguccaaagagaaggaagagacacuguggcauauccuuuacagcaucgaagauaagcaagagauugagaaagcccuccacucuuuugcuaacaagaauaaccuguccgaagaguucaucgaacaguuuaaaaauuucccuccguuuaagaaagaguaugggagcuacucugcgaaggccauuaagaaacugcucccccugaugcggaugggaaaguacuggagcaucgaaaacauugacaacggcaccagaauccggaucaauaaaauuaucgauggggaguaugacgagaacauucgcgaaagagugcggcagaaggcuaucaaucuuacggauauuacacauuucagagcccugccucucuggcuggccuguuaccuggucuaugaccgccacuccgagguuaaagauaucgugaaguggaagauccccaaagacauugaucuuuaccucaagucuuuuaaacagcauagccugcggaacccuaucguggaacaagucauuaccgagacccugagaacagugcgcgacaucuggcagcagguuggacacauugacgagauccacauugaacucggcagagagaugaagaaucccgcugauaaacgggcccgcaugucccagcaaaugaucaagaacgaaaauaccaaccugagaaucaaagcgcuucugacagaguuccucaauccggaguucggcauugaaaacgugcggccuuauagccccucucagcaggaccugcugcgcaucuacgaggaagggguccuuaauuccauucucgagcugccugaagauaucggaauuauccugggcaaguuuaaccagacggacacccucaagagacccacacggagcgagauccugcgcuauaaacuuuggcuggaacaaaaguacagaucuccuuacaccggggagaugauuccccucuccaaacuguucacaccggcuuaugagaucgaacauauuaucccucagagccgguacuuugaugacucccugucuaauaaggugauuugcgagagcgaaaucaacaaacuuaaggaucgcucccucggauaugaguucaucaagaaucaccauggcgaaaaaguugagcuggccuuugacaagcccguggagguccugucuguggaagccuacgagaaacucguccacgaaagcuauucccacaacagaagcaagaugaaaaagcugcuuauggaggauauucccgaccaguucaucgagcggcagcugaacgauucuagauacauuuccaaggugguuaaaagccuccugucuaauaucgugcgcgaagagaacgaacaagaggcuauuuccaagaaugucaucccuuguaccgggggcauuacggaccggcugaaaaaggauuggggaaucaacgacguguggaauaaaaucguucuuccgagauuuauucgccugaacgaacucaccgagagcacacgguucaccucuaucaauacaaacaauaccaugauucccagcaugccucuggagcuccagaagggcuuuaacaagaaaagaaucgaccaucgccaccaugccauggaugcuauuaucaucgccugcgcgaaucggaacauugugaauuaucugaacaaugucuccgccagcaagaacacgaaaaucacaagacgcgaccuucagacccugcucugucacaaggauaaaacagacaacaaugggaacuacaagugggugauugauaagcccugggaaaccuucacccaagacacacugacggcucugcagaaaaucaccgugucuuuuaagcagaaucuucggguuauuaacaaaacaaccaaucauuaccagcacuaugagaacggaaagaaaaucgucuccaaucaaagcaagggcgauuccugggccaucagaaaaucuaugcacaaggaaacagugcauggggaggugaaccugcggaugauuaagaccgucagcuucaaugaagcucucaaaaagccucacgccaucguggagauggaccugaaaaagaaaauucucgcgaugcuggagcuuggauacgauacgaagcgcaucaagaacuauuuugaagagaauaaagacacauggcaggauauuaaccccuccaagaucaaaguuuacuauuucaccaaggaaaccaaagacagauacuucgccgugcggaagccuauugacacaucuuuugauaagaaaaagaucaaagagagcaucaccgacacaggcauucagcagaucaugcugcgccaucucgaaacgaaggauaaugaccccacccuggcuuucuccccggaugggauugacgagaugaacagaaauauccugauucuuaacaaaggcaagaagcaccaaccuaucuauaaaguccggguguacgagaaggccgaaaaauuuacaguuggacagaagggcaauaaaagaaccaaguucguggaggcugccaaagggacaaaccuguuuuucgccaucuacgaaaccgaggagauugauaaggacacgaagaaagucauccgcaagcggucuuauagcaccauuccccucaacgugguuaucgaaagacagaaacagggacuguccagcgcuccugaggaugaaaauggcaaccuccccaaguacauucugucuccgaaugaccuuguguaugucccuacacaagaggaaaucaacaaaggggagguggugaugcccaucgaucgcgaccggauuuacaagauggucgauuccagcggaaucaccgcgaauuuuauuccugccucuacagcuaaccugaucuucgcccugcccaaggccaccgcugagauuuauugcaauggcgaaaacugcauccagaaugaguacgggauuggcagcccccagagcaaaaaccaaaaggccaucacaggagaaaugguuaaagagaucuguuuuccuauuaagguggacagacucggcaauaucauucagguggggucuugcauccugaccaacuga

SEQ ID NO: 4598 - RNA, 4563 nt, Artificial Sequence
  Cas9 variant
augaagaaaaucgugggccuggaccucgggaccaacagcauuggaugggcccugaucaaugcuuacauugaugaguauaacaaggaacaccuuuacggcaucgaggccugcggguccagaauuauccccauggacgcggcuauccugggaaauuucgauaaaggcaacucuauuagccagacagccgaccggacguccuaucgcgggaucagacggcuccgcgaaagacaucugcuucggcgcgagagacugcaccggauucucgaucugcugggauuucucccuaagcauuacucugacagccugaaucgcuauggcaaauuccuuaacgauaucgaauguaagcugccgugggucaaggacgagaccggcuccuacaaauuuauuuuccaagagucuuuuaaggaaaugcucgccaauuucacagagcaccaucccauccugauugcuaacaauaaaaagguuccuuaugauuggaccaucuacuaccuucggaaaaaggcccugacacagaagaucagcaaagaagaacucgcuuggauucugcugaacuuuaaucagaagcggggguauuaccagcuccgcggagaggaagaggaaacccccaacaaacugguggaguauuacucccuuaagguggaaaaagucgaggacagcggcgagaagaaagggaaggauacaugguauaaugugcaccuggaaaacggaaugaucuacagacggaccucuaauauuccucucgacugggagggcaagacgaaagaguucaucguuaccacagaucuggaggccgacgggucccccaagaaagacaaggaaggaaacauuaaacgcagcuuuagagcgccuaaggaugacgauuggacccuuaucaagaaaaagacagaggccgacaucgauaaaauuaagaugaccgugggcgcuuauaucuacgacacgcugcuccaaaaaccggaucagaagauucggggcaagcuggucagaacaaucgagcgcaaauacuauaagaacgaacuguaccagauucucaaaacccagucugaguuccacgaggaacugcgggacaagcaacuuuauaucgccugccugaaugaacucuaccccaacaaugagccuagacgcaacuccaucagcacacgggauuuuugucaucuguucauugaggacaucauuuucuaucagagaccccuuaaaucuaagaagucccugaucgauaauugcccuuacgaagagaaccgcuauauugacaaagaaagcggggagaucaagcacgcuuccauuaaauguaucgccaagucucauccccucuaccaggaguuccggcuguggcaguucaucgugaaucugagaauuuaccgcaaagaaaccgacguugaugugacccaagagcuccugccgacagaagcggacuaugucacgcuuuuugaguggcugaacgaaaagaaagagaucgaucagaaggccuucuuuaaguacccucccuucggauuuaaaaagaccacaagcaauuaucgguggaacuacguggaggacaaaccuuaucccugcaaugaaacccacgcucagauuaucacaagacucggcaaggcccacauucccaaggcuuuccuguccaaggagaaggaagagacccuguggcauauccuuuacagcaucgaagauaaacaagagauugagaaggcccuccacucuuuugccaacaaaaauaaccuguccgaagaguucaucgaacaguuuaagaauuucccuccguuuaaaaaggaguaugggagcuacucugcuaaggcgauuaaaaagcugcucccccugaugcgcaugggaaaauacuggagcaucaagaacauugacaacggcacgcggaucagaaucaauaaaauuaucgauggggaauaugacgagaacauucgggagcgcgugagacagaaggccaucaaucuuacagauauuacccauuuccgggcucugccucucuggcuggccuguuaccuggucuaugacagacacuccgaaguuaaggauaucgugaaauggaagacccccaaagacaucgaucuuuaccucaagucuuuuaaacagcauagccugcgcaacccuauuguggagcaagucaucacagaaacccugcggacagugagagacauuuggcagcagguuggacacaucgacgagauucacaucgagcucggccgcgaaaugaagucccccgccgauaaaagagcucggaugagccagcaaaugauuaagaaugagaacacgaaucugcgcaucaaggcccuucugaccgaauuucucaacccggaguucggcaucgaaaaugugagaccuuauucucccucccagcaggaccugcugcggauuuacgaggaggggguccuuaacagcauccucgaacugccugaggauauuggaaucauucugggcaaauuuaaucagacagacacccucaagcgccccacaagaucugaaauccugcgguauaaacuuuggcuggagcaaaaguaccgcuccccuuacaccggggaaaugaucccccucagcaaacuguucacgccggcguaugagauugagcauaucauuccucaguccagauacuuugaugacucucugagcaacaaggugaucugcgaauccgagauuaauaaacuuaaagaucggucucucggauaugaguucaucaagaaccaccauggcgaaaaaguugaacuggcuuuugacaagcccguggagguccugagcguggaggccuacgaaaaacucguccacgaguccuauagccacaaucgcucuaagaugaagaaacugcuuauggaagauauccccgaccaguucauugagagacagcugaacgauucccgguacaucagcaaggugguuaaaucucuccuguccaacauugugagagaggaaaaugagcaagaagccaucagcaagaacgucauuccuuguaccgggggcaucacagaccgccugaaaaaggauuggggaauuaaugacguguggaacaagaucguucuuccgcgguuuaucagacugaaugagcucaccgaaucuacacgcuucaccagcauuaacacgaauaacacaaugauccccuccaugccucuggagcuccagaaaggcuuuaauaagaaacggauugaccauagacaccaugcuauggaugccaucauuaucgcuugcgccaaccgcaauaucgugaacuaucugaauaacgucagcgcgucuaagaauaccaaaauuacacggagagaccuucagacccugcucugucacaaggauaagaccgacaacaacgggaauuacaaaugggugaucgauaagcccugggagacauucacgcaagacacccugacagcccugcagaaaauuaccguguccuuuaagcagaaccuucgcguuaucaauaaaacaaccaaccauuaccagcacuaugaaaauggaaagaaaauugucagcaaccaauccaagggcgauucuugggcuaucagaaagagcaugcacaaagagacggugcauggggaagugaaucugagaaugaucaagacagucucccucaacgaggcccugaaaaagccucaggcuauuguggaaauggaccucaaaaagaagauccuggccaugcuugagcugggauacgauaccaaacggauuaagaauuauuucgaggaaaacaaagacaccuggcaggauaucaaucccucuaagauuaaaguuuacuauuuuacaaaggagaccaaggaccgcuacuucgcggugagaaaaccuaucgacacgagcuucgauaagaaaaagauuaaagaauccaucacagacaccggcauccagcaaauuaugcuccggcaccuggagacaaaggauaacgaccccacccuggccuuuucuccggaugggaucgacgaaaugaaucgcaacauucuuauccugaauaagggcaaaaagcaucagccuauuuauaaagucagaguguacgagaaggcugagaaauucacaguuggacagaagggcaacaaacggaccaaguuuguggaagccgcuaaggggacgaaucucuucuuugccaucuacgagaccgaagagaucgauaaagacacaaagaaagucauuagaaagcgcagcuauuccaccaucccccugaacgugguuauugagcggcagaaacaaggacucagcucugccccugaagaugagaacggcaaucugcccaaguacauccuuuccccgaacgaccugguguaugucccuacacaggaagagauuaauaagggggaaguggugaugcccaucgauagagaccgcaucuacaaaauggucgauagcucuggaauuaccgcuaacuucaucccugcguccacagccaaucugauuuuugcucuccccaaggccaccgccgagaucuauugcaacggcgagaauugcauucagaacgaauacgggaucggcagcccccaaucuaaaaaucagaaggcuauuacgggagagaugguuaaagaaaucuguuucccuaucaagguggaccggcugggcaacauuauccaggugggguccugcauucuuacaaauuga

SEQ ID NO: 4599 - RNA, 4575 nt, Artificial Sequence
  Cas9 variant
augaacaagauccugggccucgaccuggggaccaauagcauuggaugggccaucgugcagaaagaugagcaaggcuucuacgaaaagauuaucaacgcuggguccagaauuauccccauggacgccgagacaaugaauaacuuuaauaaaggaaucacgaagucuccugcgagcgaacggacccgcuucagaggcgcucggcgccuuauugagagaucccugcuccggcgcgaaagaauccaccggcugcuuaacacaaugaauuaucugccgccccauuacgccgagaaaauugauuuugucaaccgccucgggaaguucaucggagaggaggaaccuaaguaugccuacaaaguugacgaacacggcaaguuucaguucauuuuuaaagagucuuucaaugagaugcugaaggauuuucaggacaaacagcccgaacuggugcucaacaauaagaaggugccuuaugauuggaccaucuacuaucugagaaagaaggcucuuaaccgggccauuagcaaagaggaacugggcuggaucauccuccaauucaauaacaagcgcggguacuaccagcugagaggagaggaagacgagacacuuaccgagggccagaaaaaggaauauuuugcucugaaagucauucggguggaggccgauuccucuagcgcggggaagaagggagaaguuugguacaaugugcagcucgagaacggcuggaucuaucgcugcaaauccgaaauuccccuggacugggaggggaagaucaaagaguucauugucacaaccgaaguggaugagaacgacaauguucugaaggauaaagaaggaaaggagaagagaaaacucaagaucccugaagccggcgacuggacgcugcuuaaaaagaaaaccgagagcgaccuggauaagucuggcaagacagugggggcuuacaucuaugacacccuccuguccaacccggaucagaaaauuaagggaggccuuauccggacaauugagagagaacuguaccgcagcgagcucgaacaaauccuggacaaacagaaggaguuucaucccgagcugaaagaugggacccucuauaauaagugugucgaggaacuguaccggucuaacgaauccagacgcauuagccuuucuaauuacgacuucacgcgguucaucacagaggaugugaucuuuuaucagagaccucugaaguccaaaaagagccucauugacaacugcuccuucgaacgccggaauuaccugaaccccaucaccaaagagcuugccuaugcuccuauuaaguguaucgccaaaucucacccccuguuucaagaguucagacucuggcaguuuauuaagaaucugcgcaucauugaacgggagaaaaucgugggagauaagcugauguucgaccaggaugucacaaccgaauuucucccgacccaaaacgacuacguuauccuguucgacuggcuuaaugagcauaaggaaauugaucagaaagcgcugcucaaguauccugccuuuaaccugaaaaagaauaucgacaaauacagauggaacuauguggagaauaagagcuaccccugcaacgagacacgcgcucugcuuaaggccaaacucaacaaggcuggcaauauuccuuccgauuuccuggacaacgauacgcuggaaagccucuggcacauccuguacucuguggaggacaaauuugaaauugagaaggcccuuaaauccuucgccaccaagaaggaacugcgggaggagcagacagucgcuuuugugaaacaguucaucaauaucccucccuucaagaaagaauaugggagcuacucugcgaaggccauuaaaaagcuccugcaacugaugagaaugggaagccggugguccgagaacgaaaucucugauagcaccaaggaccgcauucagaaacuuaucgauggcgagugggacgaguccauuaagacaagaacccgggauaaagcuaucaagcucaaugaaaucaacgacuuucagggccugccccuguggcucgccagcuauauuguuuacgauagacacucugaguccggggacgugaugaaaugggaaacgccggaggacaucgauuauuaccugaagcaugucuucaaacagcacggacuucgcaaucccauuguggaaguuguggucguggagacacugaaggucgugaaggaccucuggaaaaccuauggcuacuuuaacgagauccauauugaacuggggcgggagaugaagaauccugccgauaaaagacgcagcaugaccaacaagaauaucgaaaacgagaauacaaaccugagaaucaaagcccuucucgcugaacuggcgaaucacaaggacguugagggagugcggcccuacucuccuucccaacaggagauucugaagaucuaugaagagggcguccucgauaugcugaccaaagaagaccccgauuacgagagcauuuccaagaucucuaaaauggcccuuccgagcuccucugaacugauucgcuauaaguguuggcucgagcagaaauacagaagcccuuauacaggacaggugaucccccuggcucggcuguucacguccgaguacgaaauugagcacaucaucccucaaagccgcuauuuugacgauucuuucuccaacaagguuauuugcgaaagcgccgugaacaaggacaaagauaaucuucucgcuuacgaguacaucaagcagaacgagggcaaaauuaucgaaauuggacugggcaagaaagucaagcuguuuaccgccgacucuuauacagaguucgugcaguccaauuacguggggagcguugcuaagaaaaagaaacuccugauggauaccauccccgacucuuuuaucaagagacagcuuaacgacagccgguauauuucccgcgaaaucaugaaacugcucagcucugucgugagagagaaggaagaggaggaagaggaagaggaagaggaggccauuuccaagaaugugaucgucuguacaggagcgauuaccgauaaacugaagcgggaauggggccugaacgacguguggaauacgaucaucuacccucgcuucgagagacuuaaccaacugaccaauagcgauaaauuugggcagugggaaaacaagcaggggaaaaagguuuuccaaauugagaugccccucaaacugcagaagggcuuuaauaagaaacggaucgaccauagacaccaugccauggaugcuauugugaucgccugcgcuacacagucccacgucaacuaucucaauaacgaaucugcccauagcaauuccaaggagaaacgcuacuaucugcggagaaaacuucgccggauugagauccuggaaaaacaggagcucaaggacggggugaccauuacaaagaaaaucgaaguugcgaaggaguucaacaaaccguggccuaccuucacgcaagaugcccacgaggugcugcagucuaucauugucagcuuuaagcagaaccugagagugguuaauaaagcuacaaaccgcuacgccuguuucgugaauggcaagaaggaaaucgucaaacaguccaagggagagucuugggcuauucggaaacccaugcacaaggacaccgugagcgccgccgugucccuuagaaaaaucaagacagucagccugucucaagcuauugaugacuggaccaacaucguugauaagucccuccgcaaagaaaucggccugcucuacagcaaguaugggcagaauggaucuaaaaacauuaucaaguacuuuaaagaccgggacaauaagcauaacggccuggauguguccaaagugaauguccacuauuucgacaacgauuacgcggccagcagaguggcucuugaccauaaguuuaauucugccaagauuaaauccaucaccgauacagggauucagacgauccugcucaagcaccuggagagcuauaacgaaaucaauggagacaaaauuaucgagcaccccgagcuggccuucuccgcugauggccuugacauucugaacgccaauaucaccaagcucaacaaugggaaauuucauaagccuauuaagaaaguucggaagacagaaacccugggccucaaauucaucgugggacagacaggcaacaagcgcaaaaaguacgucgaggcggcugaugggaccaaccuguuuuucgccauuuaugugagcguugacggaaucagaucuuacaagacgaucccgcuucgggaaguggccgagcgccugaaagaaggccugauucccgucccugagaagaaugauaaagacgaucaccuccuguuuuggcuuagccccggggaccugguguacguuccuuccaucgaggaagagggaagaauuguggaaaucgagaacauuaagcaagaccggaucuauaaagucgugucuugcacagaaaaugagugucauugcaucccccacuucguggcuagcccuauugucaagaccgaugagcucggcgccaacaauaaggcgcagagagcuugguccggggaaaugaucaaagagaccugcauuaagaucaaaaugaaccgccugggccagauuguuaagaucuga

SEQ ID NO: 4600 - RNA, 4581 nt, Artificial Sequence
  Cas9 variant
augaagaaaauccugggccucgaccuggggaccaacagcauuggaugggccgugcuuaaugcugccgaugacaacucccugaaguacaucgaggcggcuggcucuagaauuauccccauggaugccgccauucucggggacuucgaucggggaaauagcaucucccagacagcugaacgcacgagaauccggggcaugcgccaccugagagagcgguaucuucugcgcagagcccggcuccaucgcauucugaaccugcucggguuucugccuuuccacuacgcucaagacaucgauagauauggaaauuuuucugccgacauggaaccgaaaauugcguggcggaagaaccuugagggcgaacuggaguucaucuuuauugagagcuucaaugaaaugcucgaggauuuucgcaaaaaccagcccgaacuggucgccgacaauaagaagguuccuuacgauugggugaucuauuaccuuagaaagaaggcucuggagaaaaagauuuccaaagaggaacucgccuggauccugcugaacuucaaucagaagcggggcuauuaccagcuccgcggggaggacgaugacgaaucuaugaagaccgcuaaaacaagacaauacuuugacaagcagaucauuaaaaacaucauugauaccaaucagacauauaagggacagcggauccugauuguggagcuucaaaacggcgacaaagggaagaucuucaaaaaggaaauccccgauuggauuggacaggagaagaauaucauugucaccguggacaucgauaaagacggcaacgauaaguacgaggaaagcgggucccugagcugcagauuuaaaauuccuacagacgccgagugggaaucugaguggaagcucaucaaaaugaagacccagaaggaucuggacgaauccaacaaaacgguuggaaccuauaucuacgauagcauucuucagaaucccacacaaaaggugcgcggcaaacugguccggaccaucgagagaaaguauuacaaagcggagcucaagcagauucuggaaaagcagacagaguuccauucugaacugcaagacaaagaccucuauaucgagugucugaacgaacuuuacuccaauaacgauacccaccgcaaugccauuacggaccgggauuuuguguaccuguucaugaacgacauccucuucuaucagagaccucugaaguccaaaaagucucuuauugauaauugcccguacgagcgcaacaucuauaucgacaaagagacaggcgaaauuaaguacucccccaucaaguguauugcuaaaagccauccucuguuucaggaguuccggcucuggaaguuuaucuccucuauuagaaucuaucagcgcgaaagcguuguggaggucguggauaaacaacuggaccuguucuccagccagucuaccuccgugcagaagcucgucacagauguugacgugaccgauaaauuucugaccugcgagaaugacuacguggcccuuuucgaauggcugaacaagaaaaagaucauugaucagaaggaguuucucaaauaucggcccuucgggcugaagggagacaucgacaauuacagauggaacuacgucgaagauaaaagcuauccuuguaaugagacacacgcuaugauucugacguacuuugccaaggccggcaucucugaagacauucuuaccaaagagauggaggaagcucucuggcacauccuguauagcguggaggaucgccaagaaaucacaaaggcgcugcggaccuucgccuccaaguaccaucucucugacagcuuuguuaaaguguucuccaacauucccccguuuaagaaagaguaugggagcuacucugcuaaggccaucaaaaagcugcuuucccugaugagaaugggaaaguauuggagcgaagaugccauugacgucaauacacgggagcgcaucgauaaaauugugaccggcgaguacgacgaaaagaucagagaucggguuagagagaaaacgauccgccucaacgacauucggcacuucagagcucugccugauuggcuggccugcuacguggucuaugaccgccauucugaaacaagagagaucaccgaauggaagucccccgaggagauugaugaauacauccggaacuucaaacagcacagccuucgcaauccuauuguggagcaggucaucaccgaaacacucagaaccgugcgggacauuuggaagcagguuggguguaucgacgagauccacguggagcugggacgcgaaaugaagaaccccgcggauaaaagaaagcggauuacaucccaaaucauugagaaugaaaacgcuaaucugcgcgucaaagcccuccugacggaguuugugaaccccgaguucgagaucgagaauguuagaccuuauucucuuggccagcaggacauucugcggaucuacgaagauggcgugcucaacagcgucgccgaggugccgggggacaucgcuggcauucugaagaaauuuaaugaaaacgaugccaagaaacgccccaccacauccgagauccugagauauaaacuuuggcucgaacagaaguaccggucuccuuauaccggagagaugauuccccugagcaaacuguucacauccgcuuacgagaucgaacaugugauuccucaaagcagauacuuugacgauucuuucuccaauaagguuaucugcgaggccgaagucaacaaacucaaggacaaugcgcugggguaugaguuuaucaaaaagcaccauggagaaaagguggagcuuggcuucgggaaaauuguggagaucuuuagcgucucuguguacgaacaguucguuaaggauaacuauucccgcaaucggggcaaaaugaagaaacugcucauggacgagauucccgaacaguuuaucgagagacaacugaacgauagccgcuacauuucuaagguggucaagacccugcuuagcaacgugguucgggagaaagccgaacaggaggcuguguccaagaaugucaucguguguacgggaggcguuaccgacagacucaaaaaggacugggggauuaacgauguguggaauaaaaucguccugccgcgcuuccugcggcucaacgaacugacaaauagcaccaacuuuacagccaagaaugcugccggaaacgagaucccugcgaugccccuugaacugcagaagggcuucaauaaaaagagaauugaccaccgccaucacgccauggaugcuaucgugauugccugcgcuaaccggaauaucgugaacuaucucaauaacgagucugccuccagaaaagccaagauuagccggcacgaccugcaggcuauccugugugauaaaguccgcaccgacgauaaggggaauuaccaauggagaguuaagaaaccuugggacacguucacacaggauguguauguggcgcuugagaacaucauugucuccuuuaagcagaaccugcgggugaucaauaaaaccucuaacuacuacuggcauuaugaaaauggaaagaaaguucucgugaagcaggucaaaggcgacagcugggccauucgcaagcccaugcacaaggauacaguguucggggagguuaaccugagaaaagugaaguccgucucucucaaugaagcucugaaaaacccucaauuuaucguggagaaggaccuuaaacggcagcugcucagccugcugcagcagaauuucgauauuaagaagaucaaaaaguacuuugaagaacauaaagacaucugguccgacauuucucuuagcaagaugaacaucuauuacuucaccaaagagaccaaggauagauauuuugccacacgcaagccccuggacgccuccuucgauaaaaagaaaauugaaagcugcaucacggacaccggcauucaacagauccuccugcggcaccucgagcugaaggaaaaugauccggagagagcuuuuucuccugacggaauugaugaaaugaaccgcaauaucauccagcuuaacaaaggcaaggggcaccaucccauugccaagguucggguguacgagaaagcggacaaguucgaggucggacaaagaggcaauaaauccagcaaguuuguggaagcugccaaagggacaaaccuguucuucgccguguaugagaccgaauaccccgaugagaagacaaauucuaucguccgcaaacggaacuacgcuaccauuccucucaauaucgccauugagagacagaagcgcggacuguccacggcgccggaagacgagaagggcaacguucccagcuuugugcugucuccuaacgaucuuguguaucugcccacauccgaagacaucgucaaugggcacaucacccagccuauugauaaaagcagaaucuacaagaugguguccagcucuggcagccagugcuucuuuauuaaacauaacaucgcuaauauuaucguugacaaguaugaguucagcccccucaacaaaauggaacgggccaucucuaaugagaugauuaaggagaucuguauuccugugaaggucgaccgccugggaaacaucgugaaacucggcaagagcgaauga

SEQ ID NO: 4601 - RNA, 4581 nt, Artificial Sequence
  Cas9 variant
augaagaaaauccugggccucgaccuggggaccaacagcauuggaugggccgugcuuaaugcugccgaugacaacucccugaaguacaucgaggcggcuggcucuagaauuauccccauggaugccgccauucucggggacuucgaucggggaaauagcaucucccagacagcugaacgcacgagaauccggggcaugcgccaccugagagagcgguaucuucugcgcagagcccggcuccaucgcauucugaaccugcucggguuucugccuuuccacuacgcucaagacaucgauagauauggaaauuuuucugccgacauggaaccgaaaauugcguggugcaagaaccuugagggcgaacuggaguucaucuuuauugagagcuucaaugaaaugcucgaggauuuucggaaaaaccagcccgaacuggucgccgacaauaagaagguuccuuacgauugggugaucuauuaccuucgcaaaaaggcucuggagaaaaagauuuccaaagaggaacucgccuggauccugcugaacuucaaucagaagagaggcuauuaccagcuccgcggggaggacgaugacgaaucuaugaagaccgcuaaaacacggcaauacuuugacaagcagaucauuaaaaacaucauugauaccaaucagacauauaagggacagagaauccugauuguggagcuucaaaacggcgacaaagggaagaucuucaaaaaggaaauccccgauuggauuggacaggagaagaauaucauugucaccguggacaucgauaaagacggcaacgauaaguacgaggaaagcgggucccugagcugucgguuuaaaauuccuacagacgccgagugggaaucugaguggaagcucaucaaaaugaagacccagaaggaucuggacgaauccaacaaaacgguuggaaccuauaucuacgauagcauucuucagaaucccacacaaaaggugagaggcaaacugguccgcaccaucgagcggaaguauuacaaagcggagcucaagcagauucuggaaaagcagacagaguuccauucugaacugcaagacaaagaccucuauaucgagugccugaacgaacuuuacuccaauaacgauacccacagaaaugccauuacggaccgcgauuuuguguaccuguucaugaacgacauccucuucuaucagcggccucuuaagagcaaaaagucucuuauugauaauuguccguacgagagaaacaucuauaucgacaaagagacaggcgaaauuaaguaccugcccaucaagugcauugcuaaaucccauccucucuuucaggaguuccgccuguggaaguuuaucagcuccauucggaucuaucagagagaaucuguuguggaggucguggauaaacaacuggaccucuucagcucccagagcaccucugugcagaagcuggucacagauguugacgugaccgauaaauuucuuaccugugagaaugacuacguggcccuguucgaauggcucaacaagaaaaagaucauugaucagaaggaguuucugaaauaucgccccuucgggcugaagggagacaucgacaauuaccgguggaacuacgucgaagauaaauccuauccuugcaaugagacacacgcuaugauucuuacguacuuugccaaggccggcaucagcgaagacauucucaccaaagagauggaggaagcucuguggcacauccuguauucuguggaggauagacaagaaaucacaaaggcgcuccgcaccuucgccagcaaguaccaucuguccgacucuuuuguuaaaguguucagcaacauucccccguuuaagaaagaguauggguccuacagcgcuaaggccaucaaaaagcugcugucucucaugcggaugggaaaguauugguccgaagaugccauugacgucaauacaagagagcggaucgauaaaauugugaccggcgaguacgacgaaaagauccgcgauagaguucgggagaaaacgaucagacugaacgacauucgccacuuccgggcucugccugauuggcuugccuguuacguggucuaugacagacauagcgaaacacgcgagaucaccgaauggaagucucccgaggagauugaugaauacaucagaaacuucaaacagcacucccuccggaauccuauuguggagcaggucaucaccgaaacacugcgcaccgugagagacauuuggaagcagguugggugcaucgacgagauccacguggagcugggacgggaaaugaagaaccccgcggauaaacgcaagagaauuacaagccaaaucauugagaaugaaaacgcuaaucuccgggucaaagcccugcuuacggaguuugugaaccccgaguucgagaucgagaauguucgcccuuauucccugucucagcaggacauucucagaaucuacgaagauggcgugcugaacagcgucgccgaggugccgggcgacaucgcugggauucugaagaaauuuaaugaaaacgaugccaagaaacggcccaccacauccgagauccuucgcuauaagcucuggcuggaacagaaguacagaucuccuuauaccggagagaugauuccccugagcaaacucuucacauccgcuuacgagaucgaacaugugauuccucaaagccgguacuuugacgauucuuucuccaauaagguuaucugugaggccgaagucaacaaacugaaggacaaugcgcuuggcuaugaguuuaucaaaaagcaccauggggaaaagguggagcugggauucggcaaaauuguggagaucuuuagcgucucuguguacgaacaguucguuaaggauaacuauuccagaaaucgcgggaaaaugaagaaacuccugauggacgagauucccgaacaguuuaucgagcggcaacugaacgauagcagauacauuucuaagguggucaagacccuucucagcaacgugguucgcgagaaagccgaacaggaggcuguguccaagaaugucaucgugugcacgggcggaguuaccgaccggcugaaaaaggacuggggcauuaacgauguguggaauaaaaucguccugccgagauuccuccgccugaacgaacuuacaaauagcaccaacuuuacagccaagaaugcugccgggaacgagaucccugcgaugccccuggaacuccagaagggauucaauaaaaagcggauugaccacagacaucacgccauggaugcuaucgugauugccugugcuaaccgcaauaucgugaacuaucugaauaacgagucugccucccggaaagccaagauuagcagacacgaccugcaggcuauccuuugcgauaaaguccggaccgacgauaagggcaauuaccaauggcgcguuaagaaaccuugggacacguucacacaggauguguauguggcgcuggagaacaucauugucuccuuuaagcagaaccucagagugaucaauaaaaccucuaacuacuacuggcauuaugaaaaugggaagaaaguucuggugaagcaggucaaaggagacagcugggccauucggaagcccaugcacaaggauacaguguucggcgagguuaaccuccgcaaagugaaguccgucucucugaaugaagcucuuaaaaacccucaauuuaucguggagaaggaccugaaaagacagcuccugagccugcuucagcagaauuucgauauuaagaagaucaaaaaguacuuugaagaacauaaagacaucugguccgacauuucucugagcaagaugaacaucuauuacuucaccaaagagaccaaggaucgguauuuugccacaagaaagccccucgacgccuccuucgauaaaaagaaaauugaaagcugcaucacggacaccgggauucaacagauccugcuccgccaccuggagcuuaaggaaaaugauccggagcgggcuuuuucuccugacggcauugaugaaaugaacagaaauaucauccagcugaacaaaggaaagggccaccaucccauugccaagguucgcguguacgagaaagcggacaaguucgaggucgggcaacggggaaauaaauccagcaaguuuguggaagcugccaaaggcacaaaccucuucuucgccguguaugagaccgaauaccccgaugagaagacaaauucuaucgucagaaaacgcaacuacgcuaccauuccucugaauaucgccauugagcggcagaagagagggcuguccacggcgccggaagacgagaagggaaacguucccagcuuugugcuuucuccuaacgaucugguguaucuccccacauccgaagacaucgucaauggccacaucacccagccuauugauaaaagccgcaucuacaagaugguguccagcucugggagccaguguuucuuuauuaaacauaacaucgcuaauauuaucguugacaaguaugaguucucuccccugaacaaaauggaaagagccaucuccaaugagaugauuaaggagaucugcauuccugugaaggucgaccggcucggcaacaucgugaaacugggaaagagcgaauga

SEQ ID NO: 4602 - RNA, 4584 nt, Artificial Sequence
  Cas9 variant
auggccaagauccugggccucgaccuggggaccaacagcauuggaugggcuaucguggagaaagauggcaaugacuucucccuugucgauaaggggguuagaaucuuuucugaaggagugaaaagcgagaagggcauugaauccucucgggccgcggagcgcacaggguacagaagcgcucggaaaauuaaguaucgcagaaagcugcggaaauacgaaacgcucaaggugcugucccuuaacggaaugugcccccugucuaucgaggaggucgaagaguggaaaaagagcggcuucaaagaauauccucucaauccggaguuucuggaguggcugcgcaccuccgacgaugaaaacaucaaucccuacuucuuuagagacaaggccagcaagcagaaagugacacucuucgagguuggccgggccuuuuaucacauugcucaacgcagaggguuccugucuaaccggcuugaucaguccgccgaaggaauccuggaggaacauuguccuaagauugaggcucucguggaggaccugaauagcaccgaugaaauccuuacaucucugaaagacuacuuuuucgauaccggcauucucgacgccaacgagaaagggggauuugcgaaagaucuggacgaaggcgacaagaaacuggucucccucuaucgcagcauccaggccauugugaagaagaaugauacagacuucgagaaagggaaggcugaaaucaucgagagacugaacaaaaaggauguucuuggaaaagugaagggcaagauuaaagacaucucucaggccaugcuggagggcaauuuuaagacccucgggcaauacuucuucucccuguacaacaaagaacggauucgcaaucaguauacgagcagagaggaucacuaccuugaagaguuuaagaucauuugcaaauuccagggaaucggcuccaucaaccagaaugaaaagcugcccgagaagaaauuugaggggcucgcuaaggaacuguauaaagccauuuucuuucaacggccucugaagucucagaaaggacucaucggcaaguguagcuucgagaaguccaaaagcagaugcgcgauuucucaucccgacuuugaagagaagcgcaugugggaguaccugaacaccaucaaaauugggacacaguccgaaaagguccuucgguuccugagccaggaggaaaaacucaaccugaucccuaaguuucuuagaaagaaggauaauuucaacuuugaggaccuggccaaggaacucaucgagaaaggagcuaccuucggcuuuuauaagucuagcaaacgcgauuccuuccacuacugguucaauuauaagccgacagacaccgugucuggcugucccgugagcgccucccugaaaagcgucguuggggaggauuggaagacgaagucuuuuauuuacaaaacaaccaacuccaagggaaucgaagugagccggacagugaauuacaaagaccuguggcaucuccugucugucuccaccagcgacauuuaucuuuacgaguaugcuaagaacaaacugggccucgaagauaagaaugccaaggccuucuccaaaaucaagcugaaaaaggacuuugggaaccugucucuuaaugcuauuaacaaaauccucccuuacaugagagagggacugcuguauagccacgcgguguucauggccaauauugaauccaucguugaugaggugaucuggaacgaccucggccaacgcaaguacauucaggauaagaucgcugccauuaucgccaauaacauugucgacaaugggcugcuugaggugguuaacggccugaucaaagaaugcaagguggauggagcuuauuacucuaaagaggccgcggacaccuaccggaaggaucucagcaaaaagcuggucuccuuuuucaaauuucaccauaucgacgauggcauuaagcaggaaacaauccugaacgagcuuuuccccguguuuauugaacaacucaaggcucacgaguucaucaaagucaagagacuggacgagaaagugcuggaauuucucaagggggagaaucaggauggagaaguuuucuguaacaaugccaaacagcugaagaaacuuuaucauccuagcgacauugagguguuuaaaaagcagaucgucaaagacaaggauggcacggagaccgggcaacugauccucggaucuccccugacauccagcauuaaaaacccgauggccaugcgcgcucugcaccagcuucggaaggugcucaauacccugaucguugaagaacagguggacucuuccacacgcauucacaucgagauggccagagagcugaacgaugcuaauaagcggaaaggcauucaggacuaccaaaacgaaaauaagaaagagagagagaaguaucgggaugaaaucaaaaagcucuaccuggccgagugcaacaaggaaaucgagccuaccgucgacgaucuucugcgcuaucagcucuggauugaacaggacagaaaagagaucuacgagaaugggaacagcauuucuaucugugauauuaucggcgacaaucccgcguaugauauugaacauacggugccucggagcaucucccaggacaacagccaaaugaauaagacacugugcucucagaaauucaacagagaugugaagaaacagaagaugcccuucgagcugggaaaccaccuugaaauccucccccgcauugcccauuggaaggaggaagcugacaaucugucccgggagaucgagaugauuaucagaagcaccaaaaccgccgcuacaaaggaagccaaagacaagaaaauucgcagacggcacuaccugacccuccgcagagauuaccugcagggcaaguaugaccgguuuaucuggacagagccuaaaguuggguucaagaacucccaaaucccggauacgggaauuaucacccgcuacgcgcaggccuaucuuaagucuuacuuuaauagagucgaaagcgugaaaggcgggaugguggcugaguuccggaagauuuggggaauccaggaguccuaucaagaaaacggcaaaaaguacuuuaaagagaaggaccgcucuaagcauacacaccacaccauugaugccaucacaaucgcuuguaugaccaaagacaaguaugauguccuggcccaugccuggacgcucgaagacaaagagcagauuaccgaagcuagaaagaucguggcggagagcaaacccuggaagacauucaaggaggaucugaaaaagauugaagaggggauccugguuucccacuacaccccugacaaugugaaaaagcagucuaaaaagauuguccgggugcgcggcagaaagcaguacguugccgaaaucgagcgggaugugaacggaaaagcugucgccaagaaagacauuagcggcaaggugaucuauaaacuugacaaggaugggaaaaagcugcccagacuccaacagggagacacaauccgcggcucccugcaucaggauagcauuuacggggccaucaagaauccucucaaaaccgaagagauucgguauguuaucagaaaggaccuggagucuauuaaggcuuccgauguggacaacaucgucgaugaaauggugaaggagaaagugaaggaagccaucgcgagcaagguccuuauucugucuuccaauccccagcagaaaaacaagaucgacggaaaaguuuggaugaaugaggaaaagggcauuccgaucaacaaagugcgccucuacgcuaauagcgugaagaacccucuggagauuaaggagcacucuucccugagcaaaucccggcacgaacauaagcaaaaagucuaugggcagaaugaugagaacuuugccauggccaucuacgaaggccuugacaagaaaggaaagacggagagagcuuucgagcugaucaacuauauggaugccggcuacuacuauaagcucaaaaauaagaacgaacgcaaaaaggacauuaucagccuggugcccgagaaacacauugaaacaggguuuaaucuccugcggucuaacaagaucccuauuauccuuaaaaagggacugaauguuauucucuacaagaacgagaaagaagagaucgauuucaauaaccccaauagcaucauuaagagacuguauaaaaucuccggccuggacaaggacgggauuaaacuuauguacugcaucucugcgaagggaagcaccgagaacauugcuuauaugaaugaugugaucaacaagcagaaacuguuugaacucaaguccgagauggaaaaacugggccucugggacaaggucuucucugauuucaaaaaugacaaccugaaaaagagcgacuuuuucaagaaacuuaaugaucugcugaacaagcauuacuuugagaauaacgugugcgauuccaucggcucuauuaagaaaguuaagaucaaggaaagcgggcucacaaccccuaaaggaggcgacgugauugauaacuucaaggacuuucccuauaucaaauucaaggucuccaauuuuaacgcccugauugaggggaucgauuucaaaaucagcccgaccggaaaguuugugcaaauuuga

SEQ ID NO: 4603 - RNA, 4587 nt, Artificial Sequence
  Cas9 variant
augaagaaaauccugggccucgaccuggggaccaacagcauuggaugggcccuuguggagcaggauuucaagaauaaacaaggcaacaucauggggaugggauccagagucauucccaugucucaggaaauccugggcgaguuugcucgggggaauacaaagagcgaaacggccgagcgcaccagacuccgguccguucgcagacugcgggaacgccaccuucugagacgggagcgccuccauagagugcugcacauucugggauuccucccuaaacauuacgugaaccagaucgacuuucaggagcggcugggcaaguucuuugaagagucugaaccgaagcuggcguaugauacaggcgacuuccuguuuaaacccagcuuccucgagaugcuggaggaauuuaagauccaccaaccuuccuucgucgagggggauaaaaaggugcccuacgacuggaccauuuauuuucuucgcaaaaaggcucugacagaaagaaucgagaaggaggaacucgccuggguuauucugucuuucaaucagaaacggggauacuaucagcugcgcggcgaggaugaagaggaaaagccuaacaaacucgaggaauuuuacagccugaagaucguggacauuaaagucgaugagucccccaauaagaaaggggacaccugguauagccuuacacuggagaacggauggaucuacagacggucuuccaaggugccucucgaugacuggcugggcaagaccagagauuucauuguuacgaccgacaucgacgaagaggggaauccgaaacuugauaaggaaggaaaccccaaacgcagcuuccgggccccuucugaggacgauuggggccugagaaagaaaaagacagaaaaggagauccucgacuccagcaaaaccgugggccauuuuauuuucgagaaucugcuggcugaucccacacagaagaucaaagggcgccucguccggaccauugaaagaaaguuuuacaaagacgagcugaagcaaauccuugugucucagaaccgcuuccacccugaacuguccgaugccgacaugauggcugauugcgugcgggagcucuauaagcacaaucauagccaccagaacuuucuggccuccaaagacauuaagcaucuucuggucgaugacaucaucuucuaccagagaccccuccgcucucaaaagagcacgauuggaaauuguccgcuggaguuuaagacauucaaaaaggacggcaucgaaauuaagguuccuuauaaaguggcgcccaagucccacccucuguuucaggaguuccggcuccugcagugggugagcucucuuagaaucauucgcaaauccgaugacagcgaugucacccgggaauuucuggggacacaagacaagaccaaacagcuccuggauuaccugaugacccagucugagauggacugcaacaaacuuaugacauuccuccugacgcaggaaggauauaaaagaaaggaucuuaagagcgaggugggcaaauuucgguggaacuacguuuucgacuccgagaccggggaaucuaagacauaucccggaaauagcacccgcgccgaguuccucaaaagacugggcaagguggaaggcuuugauuucuccaaauacacagaggaauuugaggagagccuuuggcaccuggucuacucugugaccgacaagguugaguucgaaaaggcucuccggaaauuuuccagaaagaacgggaucgaaaucaauagcuucguggagaaccugaaaaaguuucccccuuauaaaucugaauacgccuccuauagccugaaggcuauuaagaaacuucucgcccugaugcgcuucggagagaauuggaaggaggauuccaucgacucuauuagcaaacaucggaucgaaaagauucugacgggcgaguacgauccggaaaucaaagacaaggucagagagauuucccgcgcguuugacgagguggaagauuuccaagggcuccccgucugguuugccaacuaugugguuuacggaagacacucugaggcuagcgaacugaucaaguggacauccagcgacgagauggccgauuucaucaaagaauuuaagcagcauucucuucggaauccuauuguggagcaggucgugcuggagacccuccgcguugugaaagacaucugggauaaguauggccacgggcagaaagacuucuucgaugaaauucaugucgagcugggcagagaacugaagaaccccgcugagcaacgggcccgccuuaccacacagaucuccgccaaugaaaacaccaaucucagaauuaaaagccugcugguggagcuccugcacgacccuggaguggagaacguucggcccuacucuccgaugcagcaggaaauccuuaagaucuacgaggaaggcguccugaaguccagcuuugaggugccugaugacauucucaaaaucucuaagacagcucaacccagcuccagcgaucugaaacgcuauaagcuguggcuugaacagaaauacagaucuccuuauacggggaagauuaucccccucaauaagcuguucaccccugcguacgagguggagcacgucauuccccagucccgguauuuugacgauagcuucuccaacaaagugaucugugaagccgcuguuaauaagcugaaagacaaccgccucggaauggaguuuaucaagugcuuccauggccagagagugucucugggguuuggagaagaggucgagauuuucagcgaauccgccuacaaagccuuuauccaagacaacuucccgaagaauccugcuaagaaacggaaacuucugauggaugagcuccccgaacagaugguggagagacagaugaacgacacacgcuauauuucuaaguuuguuaccagcauccuguccaauauugugcggucugaagagaacgauacaggcuucaauagcaagaacaucauccccgggaauggcaaaauuaccacggcccugaagcaagacuggggacuuaacgaugucuggaaugagcugauccucccuagauucgaacgcaugaaccagcugaccggcacaaccguguuuacagcguggaaugagaaccaccagaaguuccucccgaccguuccccuggaauacgcuaaaggguuucagaagaaacggauugaccauagacaccacgccauggaugcccuugugaucgcuugugccacgcgcgaccaugucaauuaccugaacaaugagcacgcucucggaaagaacuauaaaggcaaggaagagaagcaaucccggagauucgaucugcgccagaaacugugccuuaagaaaaagaacgggcauagccaggagcaguacgaauggaucuuuucuaaaccuugggacuccuucacacaagaugccaagaaaaaucuggagcggaucauugugagcuuuaagcagaaccucagagugaucaauaagaccucuaacaaauaucuguccuacaaggacgaagagggaaaucuccggcuggacagccagggcaaacccgucaaggcgcuuacacgccagaucaaaggggaugccugggcuauuagaaagucuauccacaaggacaccguuuccggccuggugaaacuccggcgcgugaagauggucaaccugagcguggcccuggauaauccugaaaacauucuuaauaaaaagcugaaaaagaagaucgcugagcucguuaaacugaacuaugacaauaagcuccugcuuaaauacuucagagaucgggacuauauguuugauggaagagagguguccaagcuggacgucuacuacuucgaagagggccuggccgcgagccgcgugucucucgauaccagcuuuuccgacaaaaagauucaaucuaucacagauacggggauccggaagauucugcuugcccaucuggcuaacuaucacggaagacucgacgaaaaaggcaagguuauucccccugagacccuggccuucacacccgaggggauugaggaacucaauaaaaacaucaagggacugaauggcgggaaauuucaccagccgauuuucaaggugcgcaccuacgaaccuaaaggcaacaaguuccaggucggauuuaagggcaacaaaaauagcaaguauguggaggcugccaaagggacaaaccuuuucuuugccaucuaccugaaugaugaaggaaagcgguccuaugagaccauccccuucaacguugugauggagagacugaaacaaggcgaagggccugucccccagacgaaugagaagggaggcaagcuccuguuucaucuuucuccgaacgaacugguguacgugccugagacagacgaaaauuauaccaacgucgacuucaaaaaucucagcaaggagcagguugagaaaauuuacaagaugguguccucuaccggcagcgaaugucacuuugugcgcgcugauaucuccagccugauuaaaggguacgacgcgaagacaaaggucggagagcucggcucucugaacaaacaggaagugaccaauaacgggaugacacggaucaaggagaaaugcuggaagauuaaaaucgauagacuuggauccauuuga

SEQ ID NO: 4604 - RNA, 4587 nt, Artificial Sequence
  Cas9 variant
augaagaaaauccugggcauugaccucgggaccaacagcaucggaugggccguggucaauuccuucgaugagaaccagaaugaagagucucugaagcacauugaaugcguuggcagcagaaucauucccauggacgcugccauccuuggggauuuugacaaaggaaacuccaucucucaaacagcgaagcggacggaguuccgcagcgugagacaucugcgggaacgccaccuccugagacgggcucgccuucauaaaauucugucccuccugggcuuucugccugaucacuacgugcaggaccucgauucucaugggaauuucccggucaacguggagcccaagaucgccuggagaaaggacagcaauggagccuuugaguucauuuuuaacgauuccuucgacgaaaugcugcaggauuuugcuaccuaucagccugagcuuaucgccuguaauaaaaagguucccuacgacuggacaauuuauuaccugcggaaaaaggcucucaccaaaaagcugagcaaggaggagcuuucuuggauccugcucaacuucaaucaaaaacgcggcuauuaccagcugagaggcgaggaagaugacgaguccgucaagagcgccaaaacacggcaguauuuugaccgccagaagauuaaaucuaucguggauaccaaccaaacauacaaggggcagaaagugcugaucguugaacucgaggacggaauuaagggcaagaucuucaaaaaggaaauuccuaauuggguggggcaggagaaauccaucauugucaccaucgauaucgacaaggauggaugcgacaaauacgaggaaagcggcgagcugucuuguagauuuaagauucccuccgaugcggaaugggagagcgaauggaaacuuaucaaaaugaagacgcagaaagaccuggaugccuccgggaagaccgugggagcuuauauuuacgacgccauccuccaaaacccuucucagaaaauucggggcaagcuggugcgcacaaucgagagaaaguauuacaaagaggaacuuaagcagauccugaaaaagcaagucgaguuccacccggaacuccgggauaaagaccuguuccuggacugccucaaugagcuguaucccaacaacgaugcucacagaaaugccugugcggaccgcgauuuuauuuaccuuuucauggacgauauccuguuuuaucagcggccucucaagagcaagaaaucccugauugccgacugccccuacgaaaagcauauguacagagauaaagagaccggcgagcuuaaguauagcucuguuaaauguaucgcuaagucccacccucuguuccaggaauuucgccucuggcauuucauuagcaacauccggauuuaccagaaagagagagugguggacgucgaugccgaccaaucugcucugagcuccgcccgcucugcccucaagagcaagcuggaagcugauguggacguuacaaaugaguuucugaccugcgaggcggauuaugugucccuuuucgaauggcugaacaauaaaaagagcgucucucagaaagacuuucucaaguaccccgccuucgggaucaaaaaguccggagacaacuaucgguggaauuacguggaggauaagagcuauccguguaacgaaacgagagcucugauccugucucaccuugagaaagccaauauucgcggcgacaucuuuacacgggaacaggaggaggcccucuggcacauucuguacuccguugaagauagauacgagaucgugaaggcucugcagagcuucgccgcgaaauaucgcuuuaacgacgauuucgucaccguguucuccaaguuuccucccuucaaaaaggaauacgggucuuauagcgcuaaggccauuaaaaagcuccugccucuuaugcggaugggaaaauacugguccgaggccgcuaucgacaucaagacaagagaacggauugagaaaaucauuaccggcgagugcgaugacucuauccgcgaaagaguccggcugaaggccauuagacuccaugauaucggggacuuucgcgcucugcccguguggcuggccuguuauguuguguacgaucggcacagcgaguccggagacaucaccaaguggaaaacaccccaagaaauggauugguauauucagaauuucaagcagcauagccuuagaaacccuaucgucgaacaggugauuacggaaacccuccgcguugugagagacaucuggaaacaagucggccggauugacgagauccacguggagcugggccgcgaaaugaagaauccggcggauaaaagagccaagaugacagcucggaugaucgagaacgaaaauaccaaccugcgcauuaaagccaugcucacagaguuucugaaccccgaguucgaaaucgagaaugugagaccuuacucugcuucccagcaggacauucuucggaucuacgaaaacgggguucugaauagcgucucugagauucccgaagagaucaccggcauucucaagaaguuuaacgagcgcgaacagagaaaacggccuuccacgagcgaggugcugcgcuauaagcuguggcuugaacaaaaauacagaucucccuauacaggaaagaugaucccgcucgggaaacuguucaccccugccuacgagaucgaacauauuaucccccagagccgguauuuugaugacuccuucaauaacaaggugauuugcgaggcggaggucaauaagcugaaaggaaaccuccugggcuacgaauuuaucaagaaacaccacgggagacgcguggaucuuggccugggagagauuguugacaucuucagcguggaugaauaugagaccuuugucaaggacuacuacucugccaaucagcaaaagaugaagaagcuccugauggaugaaaucccugagcaguucauugagcggcagcugaacgacuccagauauaucagcaaagugguuaagucccuucucucuaauauugugcgcgaacaggaugagcaagaaagcaucuccaaaaaccugauugucugcacaggcggggugaccgaccggcugaagaaagacuggggaaucaaugauguuuggaacaagcucauccugcccagauuccagcgccuuaauaacauuacagagacgaccgaguuuacagcuaagaacaugcagggccaugaaaucccugugguccccuucgaguaccagcggggguuuaauaaaaagagaauugaccaccgccaucacgccauggaugcuaucgugauugccugugccggacggaacaucgugaauuaucugaacaaugaaucugcucggaaaaaggcgcaaauuagcagauacgaccuccagcgccugcugugcgauaaagucaagaccgacgauaacggcaauuauaaguggauccuuaaaaagccgugguccacacugacccaggacguuuacgccgcucucgauaacgugaucgugucuuucaaacagaaucugagagucauuaacaagacgaauaaccacuaugugcauuacgaggccgggaaaaagaucauugccaaacaagaaaaggcuagcugggccauccggaagccuaugcacaaagacaccguuuuuggcgaggugaaucuccgcaaggucaaaacagugucccugaacgaggcgauuaagagcccccauuguaucguucagaaagauuucaagaagaaacuucugucucuccugaagcagaauuuugacgcuaaagaagugaaggccuacuucgaggaacacaaagaugucugguccgacaucaaccugagcaagauugagguguauuacuuuaccaaggacacaaaagaaagauucuuugccacccggaagccccuugauucuuccuucgaccgcaaaaagaucgagagcguuacggauacaggcauucagaaaauccugcucagacaucuggagcaaaagaacggagacucugaucucgcuuucuccccugacgggauugaagagaugaaucagaacaucgugcagcugaauggaggccggaagcaccaaccgaucgucaaagugagaguguaugaaaaggccgauaaauuugcgauugggcagcagggaaacaaggcuagcaaauacgucgaggccgccaagggcaccaaucuuuucuuugcuguuuaugaagaggaggugcgcgacaaaaagacaaacgccgugauguucaagcggaauuacgcuuccaucccccugaacgucgccauugauagacagaaaaaggggcucagcaccgcgccugaagacgagaauggcaacgcccccaucuuugugcugucuccuaaugaucugguuuaucuucccaccgcugaagacauuaucaacgcccgcauuagcuucccuaucaauaaaaaccggaucuacaagaugguguccugcacaggauaccaaugcuuuuucauuaaacaccaugucgcuaaugugaucguugauaagaaggaguuuucugcccugaacaaaauggagaaggccgaaacgaaugagaugauuaaagacaucugugugcccauuaagcucgacagacugggcaacaucgucaaaaucgggguguauaaguga

SEQ ID NO: 4605 - RNA, 4587 nt, Artificial Sequence
  Cas9 variant
augaagaaaauccugggccucgaccuggggaccaacagcauuggaugggccguggucaauuccuucgaugagaaccagaaugaagagucucuuaagcacaucgaaugcguuggcagcagaauuauccccauggacgcugccauucugggggauuuugacaaaggaaacuccaucucucaaacagcgaagcggacggaguuccgcagcgugagacaucuccgggaacgccaucugcuuagacgggcucgccugcacaaaauccucucccugcugggcuuucucccugaucacuacgugcaggaccuggauucucaugggaauuucccggucaacguggagcccaagauugccuggagaaaggacagcaauggagccuuugaguucaucuuuaacgauuccuucgacgaaaugcuucaggauuuugcuaccuaucagccugagcugauugccuguaauaaaaagguucccuacgacuggacaaucuauuaccuccggaaaaaggcucugaccaaaaagcugagcaaggaggagcugucuuggauucuccugaacuucaaucaaaaacgcggcuauuaccagcugagaggcgaggaagaugacgaguccgugaaguccgccaaaacacggcaguauuuugaccgccagaagaucaaaucuauugucgauaccaaccaaacauacaaggggcagaaagugcucaucguugaacuggaggacggaaucaagggcaagauuuucaaaaaggaaaucccuaauuggguggggcaggagaaauccauuaucgucaccauugauaucgacaaggauggaugcgacaaauacgaggaaagcggcgagcuuucuuguagauuuaagauccccuccgaugcggaaugggagagcgaauggaagcugauuaaaaugaagacgcagaaagaccucgaugccuccgggaagaccgugggagcuuauaucuacgacgccauucugcaaaacccuucucagaaaauccggggcaaacuugugcgcacaauugagagaaaguauuacaaagaggaacugaagcagauccucaaaaagcaagucgaguuccacccggaacugcgggauaaagaccuguuccucgacugccugaaugagcuuuaucccaacaacgaugcucacagaaaugccugugcggaccgcgauuuuaucuaccuguucauggacgauauucucuuuuaucagcggccucuuaagagcaagaaaucccuuaucgccgacugccccuacgaaaagcauauguacagagauaaagagaccggcgagcugaaguauagcucuguuaaauguauugcuaagucccacccucucuuccaggaauuucgccuguggcauuucaucagcaacauucggaucuaccagaaagagagagugguggacgucgaugccugccaacccgaccugucuagcgcucgcuccgcccucaagucuaagcuggaagccgauguggacguuacaaaugaguuucuuaccugugaggcugauuaugugagccuguucgaauggcucaacaauaaaaaguccgucagccagaaagacuuucugaaguacccggcguucgggauuaaaaagucuggagacaacuaucgguggaauuacguggaggauaaguccuauccuugcaacgaaacgagagcccugauccuuagccaccucgagaaagcuaauauccgcggcgacauuuuuacacgggaacaggaggaggcccuguggcacauccuguacucuguugaagauagauacgagauugugaaggcccuccaguccuucgcugccaaauaucgcuuuaacgacgauuucgucaccguguucagcaaguuucccccuuucaaaaaggaauacggguccuauucugcgaaggcuaucaaaaagcugcuuccccugaugcggaugggaaaauacuggagcgaggccgccauugacaucaagacaagagaacggaucgagaaaauuaucaccggcgagugugaugacuccauucgcgaaagaguccggcucaaggcuaucagacugcaugauauuggggacuuucgcgcccugcccguguggcuugcuugcuauguuguguacgaucggcacucugagagcggagacaucaccaaguggaaaacaccucaagaaauggauugguauauccagaauuucaagcagcauucccucagaaacccgauugucgaacaggugaucacggaaacccugcgcguugugagagacauuuggaaacaagucggccggaucgacgagauucacguggagcugggccgcgaaaugaagaaucccgccgauaaaagagcgaagaugacagcccggaugaucgagaacgaaaauaccaaccuccgcaucaaagcuaugcugacagaguuucuuaacccugaguucaagauugaaaaugugagacccuacagcgccucucagcaggacauccugcggauuuacgagaacgggguucucaauuccgucagcgaaaucccugaggaaauuaccggaauccugaagaaauuuaacgagcgcgagcagagaaagcggcccucuacguccgaagugcugcgcuauaaacuuuggcucgagcaaaaguacagaagcccguauacaggcaaaaugauuccucuggggaagcuguucacccccgcuuacgaaaucgagcauaucauuccucagucucgguauuuugaugacagcuucaauaacaaggugaucugcgaagccgaggucaauaaacucaagggaaaccugcuuggcuacgaguuuauuaaaaagcaccacgggagacgcguggaucugggccucggagaaaucguugacauuuucuccguggaugaguaugaaaccuuugucaaagacuacuacagcgcgaaucagcaaaagaugaagaaacugcugauggaugagauccccgaacaguucaucgagcggcagcuuaacgacucuagauauauuuccaaggugguuaaaagccuccuguccaauaucgugcgcgagcaggaugaacaagagucuauuagcaagaaccugaucgucuguacaggcggggugaccgaccggcucaaaaaggacuggggaauuaaugauguuuggaacaagcugauccuuccuagauuccagcgccugaauaacaucacagaaacgaccgaguuuacagccaaaaacaugcagggccaugagauucccguggucccguucgaauaccagcggggguuuaauaagaaaagaaucgaccaccgccaucacgcuauggaugccauugugaucgcuugcgccggacggaacauugugaauuaucucaacaaugaguccgccagaaagaaagcucaaaucucucgguacgaccugcagcgccugcuuugugauaaggucaagaccgacgauaacggcaauuauaaauggauucugaagaaaccuuggagcacacucacccaggacguuuacgcggcccuggauaacgugaucguguccuucaagcagaaucucagagucaucaacaaaacgaauaaccacuaugugcauuacgaagcugggaagaaaauuaucgccaagcaagagaaggccucuugggcuauucggaaacccaugcacaaggacaccguuuuuggcgaagugaaucugcgcaaagucaagacagugagccuuaacgaggccaucaaaagcccccauugcauuguucagaaggauuucaagaaaaagcugcucagccugcugaaacagaauuuugacgcgaaggaggugaaggcuuacuucgaggaacacaaggaugucuggucugacaucaaccuuuccaagaucgaaguguauuacuuuaccaaagacacaaaggagagauucuuugccacccggaaaccucuggauagcucuuucgacagaaagaaaauugaauccguuacggauacaggaauccaaaagauucuccugcgccaucucgagcagaagaacggcgacagcgaucuggccuucucuccggacgggaucgaggaaaugaaucagaacauugugcagcuuaauggaggccggaaacaccaacccaucgucaaggugagaguguaugagaaagcugauaaguuugccaucgggcagcagggaaacaaagcguccaaguacgucgaagcugccaaaggcaccaaucuguucuuugccguuuaugaggaagaggugcgcgacaagaagacaaacgcugugauguucaaacggaauuacgccagcauuccucucaacgucgcuaucgauagacagaagaaagggcuguccaccgcccccgaggacgaaaauggcaacgcgccuauuuuugugcugagccccaaugaucuuguuuaucugccuaccgccgaggacaucauuaacgcucgcaucucuuuccccauuaauaagaaccggaucuacaaaauggugagcuguacaggauaccaaugcuuuuucaucaagcaccaugucgccaaugugauuguugauaagaaagaauuuuccgcucucaacaagauggagaaagccgagacgaaugaaaugaucaaggacauuugugugccgaucaaacuggacagacucggcaacauugucaagaucgggguguauaaguga

SEQ ID NO: 4606 - RNA, 4590 nt, Artificial Sequence
  Cas9 variant
augaagaaaauccugggccucgaccuggggaccaacagcauuggaugggccguggucaauuccuucgaugagaaccagaaugaagagucucuuaagcacaucgaaugccugggcagcagaauuauccccauggacgcugccauucucggggauuuugacaaaggaaacuccaucucucaaacagcgaagcggacggaguuccgcggcguuagacaucugcgggaacgccaccuucugagacgggcucgccuccauaaaauccugagacugcucggguuucugccugaucacuacgugcaggaccuugauggacauggcaauuuccuggugaacgucgagccgaagauugccuggcggaaggacagcaauggcaccuuugaguucaucuuuaacgauuccuucgacgaaaugcuccaggauuuugccacauaucagcccgagcugauugcuuguaaucgcaaagugccuuacgacuggaccaucuauuaccuuagaaagaaagcccugacaaagaaacucucuaaggaggaacugagcuggauucugcucaacuucaaucaaaagcggggguauuaccagcugcgcggagaggaagaugacgaguccguuaaaaccgcuaagacaagacaguauuuugaccggcagaaaaucaagagcauuguggauaccaaccaaacguacaaaggccagaagguccuuaucguggaacuggaggacgggguuaaaggaaagaucuucaagaaagaaauucccaauugggugggccaggagaagucuaucauugucaccguggauaucgacaaagaugggugcgacaaguacgaggaauccggagagcucagcugucgcuuuaaaauuccuucugaugccgaaugggaguccgaauggaagcugaucaagaugaaaacacagaaggaccuugaugcgagcggcaaaaccgugggcgccuauaucuacgacgcuauucugcaaaaccccucucagaagaucagagggaaacucguccggacaauugagagaaaguauuacaaggaggaacugaaacagauccugaagaaacaaguugaguuccacccugaacuccgcgauaaggaccuguuccuugacugccugaaugagcucuauccgaacaacgaugcccaccggaaugcuugugccgacagagauuuuauuuaccuguucauggacgauauccuuuucuaucagcgcccccugaaauccaaaaagagccucaucgcggacugcccuuacgaaaaacauauguaccgggauaaggagaccggagagcugaaauauuccucugugaaguguauugccaaaagccacccccuguuccaggaauuuagacucuggcauuucaucuccaacauucgcaucuaccagaaggagcgggugauugacgucgaugcuugccaaccugaccugagcucugccagauccgcucuuaaaagcaagcuggaagccgauguggacguuacgaaugaguuucucacaugugaggccgauuaugugucucuguucgaauggcugaacaauaagaaaagcgucucccagaaggacuuucuuaaauaccccgcuuucggcaucaagaaaucuggggacaacuaucgcuggaauuacguggaggauaagagcuauccgugcaacgaaacccgggcgcucauucugucccaccuggagaaggccaauaucagaggagacaucuuuacacgcgaacaggaggaggcucucuggcacauucuguacagcguugaagaucgguacgagaucgugaaagcccuucagucuuucgccgcuaaguauagauuuaacgacgauuucgucaccguguucuccaaauuuccucccuucaagaaagaauacggcagcuauucugccaaggcgauuaagaaacugcucccucugaugcggauggggaaguacugguccgagagcgcuaucgacauuaaaacccgcgaaagaaucgagaagaucauuacaggagagugugaugacuccauccgggaaagaguccgccugaaagccauucggcuucaugauaucgagcacuuuagagcccuccccguguggcuggcuugcuauguuguguacgaccgccauucugaaagcggcgauauuaugaaguggaagacgccccaagagauggacuccuauauccagaauuucaaacagcacucucugagaaacccuaucgucgaacaggugauuaccgagacacuccggguugugcgcgauaucuggaagcaagucggcagaauugacgagauccauguggaacuggggcgggagaugaaaaauccggccgacaagcgcaaagaaaugaccaagagaauuaucgagaacgagaauacaaaccuucggaucaaagcuaugcugaccgaauuucucaaccccgaguucgaaauugagaaugugcgcccuuacagcgccucccagcaggauauccugagaauuuacgaaaacggaguucugaauagcgucucugagauccccgaggaaauuacgggcauccuuaagaaguuuaacgagcgggaacagcgcaaaagaccuuccacaagcgaggugcuccgguauaagcuguggcuggaacaaaaauacugcucucccuauaccgggaagaugauuccgcucggaaaacuguucaccccugcguacgagaucgagcacgugaucccccaguccagauauuuugacgauagcuucaauaacaaggucauuugugaagccgaggugaauaaacuuaaaggcaaccugcucggguacgaauuuaucaagaaacaccauggccagcgcguugaccugggacugggcgagauuguggauaucuucucugucgacgaauaugagacauuugugaaggauuacuacagcgggaaucaacagaaaaugaagaaacuucucauggacgagauuccugaacaguucaucgagcggcagcugaacgauuccagauauaucagcaagguugugaagucucugcucuccaauauuguccgcgaacaagacgagcaggagagcaucuccaaaaacgugauuguuugcaccggaggcgugacagaucggcugaagaaagacugggggaucaaugacgucuggaacaaacuuauucugcccagauuccagcgccucaauaacaucacggaaaccacagaguuuaccgcuaagaacauggaaggacacgagaucccuguggugcccuucgaauaccagcggggcuuuaauaagaagagaauugaucaucgccaccacgccauggacgcuaucgucauugccugugcgucucggaacaucguuaauuaucugaacaaugagagcgccagaaagaaggcucggauuucccgcuacgaucugcaaaaacuucugugcgacaaggugagaacagaugacaacgggaauuauaaguggauccucaaaaagccguggggcacccugacgcaggauguguacgccgcucucgacaacgucauugugucuuucaaacagaaucugcggguuaucaacaagaccaaaaauuauuacgugcauuacgaggccggaaagaaaacaaucgccaagcaggaaaagggcagcuccugggcuauucgcaaaccuaugcacaaggauaccgucuuuggggaggugaaccuuagaaaaguuaagacagugucucugaaugaagcgaucaaaaacccccaauguauugucgagaaggacuucaagaaaaagcuccugagccugcuuaaacagaauuuugaugccaagaaagugaaggcuuauuucgaggaacauaaggacguuugguccgauaucaaccugagcaaaauugagguguacuauuuuaccaaggacacgaaagaacgguucuuugccacaagaaagccccucgacucuuccuucgauaaaaaggagaucgaaagcgucaccgacacaggaauccagaagauucugcuccgccaccuggagcaaaagaacggcgauccugaccuugccuucucuccggaugggaucgaagagaugaaucauaacauugugcagcugaauggaggccggaagcaccagcccaucgugaaagucagaguuuacgagaaggcugacaaauuugccauugggcagcaaggcaacaaguccagcaaauauguggaagcggcuaagggaaccaaucucuucuuugccguguacgaggaagagguccgcgauaagaaaaccaacgccgugaugcugaagcggcacuaugcuucuaucccucugaauguugccaucgacagacagaaaaagggccuuuccacagcgcccgaggaugaaaacgggaaugugccuauuuucguccugagccccaacgaccucguguaccugccuacggcugaggauaucgccaaugccuccauuagcuuucccaucaacaaaaaucgcauuuacaagaugguuucuugcaccggaaaccgguguuucuuuaucaagcaucacguggcuaaugucauuguggacaaaagcgaauuuuccguccucaacaagaucgagaaagccgaaacagaugagaugaucaaggagauuugcgugccgaucaaaauugacagacugggcaauaucguuaagauugggguguauaaguga

SEQ ID NO: 4607 - RNA, 4608 nt, Artificial Sequence
  Cas9 variant
augaacaccauccugggccucgaccuggggacaaauagcauuggaugggcccuuaucaaggugcugaacgauaaaacgagacucccccuggagauuaucgaccuuggcgucguugugauuccuaccgaucagcggacacuggacaaguucuccaaaggggaaucuaucagcaagaccgcugagcgcacaaaacaaaagggagugagaaagcucuacgaacggaaaaagcugcgcagagagcggcugcaccgcguccucaauauccugggcuuucuuccggaacauuauuccaaaaagauugauuucaaaaagcaccuggggcaguuuuucggaaacucucagcccaagaucagcuacguggagaaugaccauggcaaacacgaguuuauuuucauggauuccuauagagaaaugcucaaggaguuuucuaaacauaacaucaagaauguuccuuacgacuggaccauuuauuaccugcggaaaaaggcccuuagccagaaaaucuccaaggaggaacuggcgugggugauucucaacuucaauaagaaacgcggcuauuaccaauuuagagaugacaacgcugaugagaauaaggaaaacaaaaucgagaaguacuaugcccugaaagucacaaaugugaagaaggaagacgcccagaacuacaccaucacgcuggagaauggguggauuuauaaaaacaagagcaaaaucucucuccuggauuggguuggauccaccaaggaguucauuagcacagaaaaauuugacaacaagggcaauaucauuaagaaaaagaacggggaggacgaucggacccuuaaacugguggacucugaaaaggauuggaucgcuaucaaaaaguccacagaggaccgcauugaaaauuacggaaagaccgucggcacguaucucuacgagcaucugcuuaaagaucccaaccagaagcugaauggggaacucaucaacauuaucgacagaaaauucuauaagaaugagcugaaacagauucuggagaagcaaaaagaauuucacccugagcuccugaacgaagaucuuuuccaaaagagcaucaucgagcuguaccccaaaaauucuacacggcagaaagaacucaagaacaaagaccugugcuaccuucugauugaugacgugaucuauuaccagcgcgaucucaagaaaaagaacuccaccauuaauaaguguagcuucgaguccagagaguauuaccugaauggagaaaaacagauccagaagauuaacugcaucgccaaaucuaagccucuguaucaggaguuucggacacuccaauucauuaaaaaucugaagguguacgaaaucaucgacggccuugagaaggacauuaccagcaaacugcucccggauuuugagaccaaggaacacuucuuugaguggcugaacgacaaagaaaagaucgaucagcugcagcuucucuccuauaaauguuucgaccugcacgauaacgucaagaaugaccugauugcuaagggcaucaaaagacccacagagaaggccauucgcacggaacuccuggagaaauaccgguggaacuacagcaaggauaaugacagaaacuuucuucugaaugagacccgcuucaaaauccucaaguaucugaaaaagguugauaagaaacugacacuuaccaacgaacagaucgagucucucuggcugcugcucuacuccgcgaaggacgaacgggagcugaaaaaugggcuucaaaaguuuagcgaaaagaacaagcugccuaagaaauucucugauauuuuuaucagcuuucccccuuucaagaaagaguauggagccuacuccgagaaggcucucaaaaagcugcugucucuugugagauucggcaaguauuggagcuucaauaaaauugacaacaauauccagaacaagauuaugaauauccucaacggggaaguggaugacuccaucagcgaccgcguccgggagaaaacaauucugcugcaggauaagaaugacuuucaggaucucccccuguggcuugccucuuacguggcuuauaacagauucuccgaaguuagcgagaucaaauacugggacucuccggauaagauugaauuucugaagcaacauuccaucggaaacccuauuguggagaaaaucaucaaugagacccucaagcugauuaaagacaucugggucauucacggcaagagcugcaaaaacuucuuuuccgaaauccacauugagcugucucgcgaaaucaagagcuccucuaagaaacgggcccagauuacgaauaacaauacaaagaaccagaaacuuaauaaccucaucaagagccugcugaucgagauggcguccgauaccaaauacgagaaugugacccccuauagcccuucucagcaagaaauucucaagaucuacgacgaggggauuuauuccaaagaagagaacagcgaaaagaucaaggagauuaauaaaaucagaaacaauaacaagaucucuaaauccgauauuacaaaguacaaacuguggcuugagcagggauauaucagccccuacaccggcaagauuaucccccugacaaaacucuucacggccaaguaucagaaggaacauauuaucccucagaccaaauuuuucgacgauucuuuuaauaacaagguuaucugugaggcugaagugaacaaacugaaggacaauagccuggccaugaacuucauuaaggcuaaaggcgggaaggccgucaaacuuuccgauggagagacagugaccauccugaaucaagaagaguacaagcagcucguccgcaccagcuuuaaaaagaacucuauuaagcugcggaaucuccugcuugaggaaaucccggacaccuucacgaaaagacagcugaacgacaccaaguacauuuccaaacucgugcugagccugcuuuccaauaucguucgggagaagggcgaacuggagucuacagccaaacgcauugugagcaccaacgggcaaaucacauccauccucagaaaugauuggggacugaacaauauuuggaacaagcucaucacaccccgguuugaaagacugaauaacauuaauaaaaacaagaucuauggcaauugggagaacaagaaagggaagaacgucuuccagauuaauuaccuuaacgacaaucugucuacgcucaacacaaaacgcaucgaucaccggcaucacgcucuggacgcgcugaucguggccugcaccacaagaaaucauauuaacuuccuuaauaaccaguaugcuaagagccgcaaucagagacacgaucugcgggccaaacucaagcgcagagagaccaucaccacagaaggcuccaagaaacaaguuuuuaaggacuucauuaaaccuugggagucuuuuacgcaggaugcccugaagaaacucgaaaccacaaucgugaacuucaaggucaauaagcggauuaucaacaaaaccaucaauugguacaagaaaugggagaagcagaaagacggaacauauaagaagauucagaaaaagcaaaccaaaggcgaugcuugggccauccgcaagccccugcacauugacacgaucuacgggauuguguguaaaaagcugccucuuaaaagcgcgcuggagaacuauaagaauaucauugaugaaaaccucaagcauaaaaucaaggagcugaaagaagugaacaaguuugacaauaaccagaucauuaauuucuuuaaagagugcaacuucaucuuugaagacaauaacauucagaagguugaggucuacgauuucaaggacaauagagauaaaacaauccuuuccagcucucggcagcugauugacgaguccuuuacccccaagaaaaucggaaaggugcucgauccgaccauccgcaacauucugcucaaacaccugaauagcacaaaguacaacaauaaguucgacucugauggcaacccuaucaaacccgaaaaacuugcuuucuccccugaggggcugaaggaccugaauaagaacauuaaacaucucaauaacaacaaggaacaccaacccaucaagagagugaaacuguuugagacccuuggaaauaagauuaaagucggcuauacacagcagaagaacaaaaaguucgccgaaacggccaccgggacaaaucuguuucucggcaucuacagcgauaacaauaagcgggacuucaaaaccaucccucugauucucgcuauccaacgcgagaaggagggacugaaccccuguccggauacagacgaaaaaggcaaucagcuucuguuuucucuguccccuaacgagcucguguucguucccaauaacgaagagagaaagaaucccaaccugguggauuuugaaaaucuuagcaaagaccagauugaccggaucuauaaguucgucuccugcaccgggagcgaggccuacuuugugccuucuagaacggcuaaaccgauuaucgagaacgaaaauggaaccaacaacaagagccagcgcauuaucgaguucaaugaaaagacauccaucaaaaacgagaagaaugagcccguucugauuaaaaccaucuguuggaagauugaagugaaccggcucggcaaaaucauuaaggucaucaaguga

SEQ ID NO: 4608 - RNA, 4608 nt, Artificial Sequence
  Cas9 variant
augaccaagauccugggccucgaccuggggacaaacagcauuggaugggccaucagagauacggagaaugaaggcauuaaccagauccuugacaaaggggcucggauuuucuccgagggagugaagucugaaaauggcaaagagaucagccgcgccgcggaaagaaccgcuuaccgguccgcccgcaagaucaaauauagacggaagcugcgcaaguacgagacacucaaaguccugucuauuaacgggaugugcccccuuagcguugaggaaguggagcaauggaagaaauccggauuuaaggaauauccucugaauccggaguuccucgauuggcugagaaccaacgaggacaaaaauaucaaccccuaccuguuucgggauaaggccucuaagcagaaagugacacucuucgaacugggccgcgcucuuuaucacauugcccagagacggggcuuucugagcaaucgccucgaccaguccgcugagggggucuucgaggaacauaacccucaaauccagaaucugauugaagaucuugacagcucuaacaccauccugaaugagcucaaggaguacuauauuaaccugggaaucaucgaugaaacagagaaauccggcuuuaagaaagaccuggaugaaggggagaagaaacucaagagccuguacaauucucuuguggccauuaccaagaaaaacgcgaacgacaucgaaacguguaagcaggagcugauugccagacucaauaaaaaggaggaucugggaaaaguuaagggcaagaucaaagacauuucccaggcuaugcuugaccggaacuucaagacccuggggcaauacuuuuucagccucuauaauaaagaacgcaucagaaaccaguacacaucucgggaggaacacuaucuggaggaauuuaucauuaucugccagacccagggaauugagggcaucaauacaaacgagaagcugcccgaaaagaaguucaccggccucgccaaggaucuguacagagcuaucuuuuuccaacgcccucuuaaaucccagaaggggcugauuggaaaauguagcuucgagaagaauaaaucccggugcgccgugucucaucccgacuaugaagaguuuagaauguggagcuaccucaacacgaucaagauuggcacacaguccgagaagacccugcgcuuccuuacacuggaagagaaacucaagcuggucccuaaauuuuauagaaagagcgauuucaauuuugaagugcuggcgaaagagcucguugaaaagggggccucuuucggauacuacaaauccagcaagaagaacgaguuuuucuauugguuuaauuacaaaccgaccgacucugugagcgcuugugucguguccgccucucuggagaacgcuaucggcaaggauuggaaaauuaagaccuucgaauaucaaacacggaauacggagaaaaacgaagugaccaagagcgucgacuacaaggaucuuuggcaucugcucuccguugccacaagcgacaccuaucuguacgauuuugccaucgagaaacugaaacuugaacccaaaaaugcuaaggcguucucuaaaacaaagcucaagaaagacuuugccucccugagccuggcugccauugccaagauccucccuuaucugaaacaggggcuucuguacucucacgcuguguucauggccaacauugagaacaucguggaugcggacaucuggaaggacgaggaacagcagaaauucauucaauccaagaucgucgagcucguggauaauuacauuguugaaaagagcaaacuggagcugaucaacggacuucucaagauuuauaauaccgaagacaaagagggccgcaagguguacuauuccaaagaggcugaaucucuguuugaggccgaucugcggaagaaacucguccccuucuacaaggccaacaucaucauugaggaacacgagcaggaaaucauuuuucaggaccuguucccuauccuuauggaucagcugaagaaacaagaguuuauuaagaucggcagacucgacaaacagaucgaagcguuccuggagggggaaaaugaggagggacagaucuuuugcaaccacacggauaagcugaaaaagcucuaucaucccagcgacauugaaguguucaagaaaaagacaauuaaagaugaguggggcaaugaaaagguugugcuuggguccccgcugaccaccucuaucaaaaacccuauggccaugcgcgcucugcaccagcuccggaagguccugaauacacuuauugccaacgaccaaaucgaugaggacaccagaauccauauugaaauggcgcgcgagcugaaugaugccaacaagcggaaaggaauccaggacuuucagaaugagaacaagaaauucagagaagaggcuauuaaggaaaucaaaaagcucuaccuggaggaaugucacaaggacgugaaucccacagaggaugacauucugcgguaucagcuuuggcucgagcaaggcaaaugcgaaaucuacgaggaagggaacaacauuagcaucugugauaucauuggcuccaauccuagcuacgacaucgagcacacgauuccccgcucuaucucccaggauaacagccagaugaauaagacccugugcucucugaaauuuaacagauccauuaagaaacaaaagaugcccgucgagcucagcaauuauaacgacauccugccucggaucgcccauuggaagaaagaagcugaggaacuuacaagacagauugagaccaucucucgcagcauuaaguccgccgcgacaaaaguggccaaggauaaaaauauccggaagagacacuaccugacccucaaacgcgacuauauucugggaaaguacgaaagauucacgugggaggagccgaagguuggcuuuaaaaacagccagauccccgauaccgggaucauuacaaaguaugcucaggccuaccugaaaucuuauuucaagcggguggaauccgucaaaggaggcgcuguggccgaguuccgcaaacuuugggggauccaagagagcuuuauugacgaaaauugguggaagcauuacaaagauaaggacagagauaaacacacccaucacacaaucgacgccauuaccaucgcuuguaugccuaaggacaaauacgaucugcucgcgcacgccuggcggcuggaagacgagcaggauaagaaggcugccaaaguucucauugagcaggccaagcccuggaaaacguucaaggaagacaucgagaaaaucgaaacagagauucuggugucccauuuuaccccugauaacgucaagaagcagucuaaaagcaucauuaagaaucgcggaaagaagguguaugugcuuaaaaacgaacugcccguuaauuucaagaacaaaaucgagggcaaggacuacuuuaagcucaaauucgauuccaagauucuguauaaaaucccgaagaaaaaggagaagcaaacagacaccuuuuacgaggaacugccuaaaaauuaucuuaacggggucgaaggcaaggauuacuucaaaaucaacaccacaggaaagacguuuuauaaaauucccaucuucaaucagggcgacaccauuagagggucucugcaccaggagacaaccuacggagcuaucaagcucccugauauugacaucgagacaaagaaaccccugcauaccgacaagggcggguuuauccucaaaaaggauauuaaaggaaacgaaaucguguucuucgugguccggaaggagauuagcaagaucuccgaaaaugacgugcagaacauuguugauaaugugguccgcaaaaagaucgagaacgccauugcuaauucucugaucacguuuaaaaucgugaagaaaaagaaaguugcugugauuaaggaaggcgucacaaucuggaugagagagccuaacauugagaaggggaucgaaggcauucccaucaaaaaggugcggaucauuaccaauagcguuaaaaacccgaucgagauuaaggugcacuccccucuuagcaaaucucgccacaagcauaagcaaaaagucuacggacagaaugacgaaaacuaugccauggcccuguacgagcucgauggcaagagagaguucgaacugaucaauaacuuuaaucuggcuaaacuucugaagcagucccaaagcuauuacccccuccacaaagagaaggaaauuaaggggaaaaagauccuggugcccaucgagaaacggaacaauaaggacgugauucucaaaagaggacagcaggucguuuucuaugauaagaccguggaaaacccuaaggacaucucugagauuaucgauuuucgcgaacggauuuacaucauugagggccugacaauccagagacaaaaagacaagaaaaccuccaaggugaacgaguaugggaucauucagcuucgccauuucaaagaagccagaaagagcgaggaaaucucuaaggauaauuuuaaaccggacggagaguucaagauuaacgagaauaaacccacacggaagaugaaccacaaucaguuuacggcguucgucgaaggcaucgauuuuaaagugcugccuuccgggaaguuccagaaaauuuga

SEQ ID NO: 4609 - RNA, 4614 nt, Artificial Sequence
  Cas9 variant
augaagaaaauccugggccucgaccuggggaccaacagcauuggaugggcccuuacaacgaaugauuucgacaccaagaaaggcacaaucgaggggcugggauccagaauuauccccaugucucaggauauucucggcaaguuugacagcggggugucccugucucaaaccgcucagcggacagaauaccgcggaaaaagacggcuuguccagcgcuuccugcucagacgggagcgccugcacagaguucugcauauccucgaacugcuuccuaagcaguauagcgaggccaucgauuuugacaagaaacugggccaauucaagccggaacgggagcagaaaauuuccuuuuacaagaacgagucuggcaaaaaucaguucaucuuuaccaagagccaccaggaaaugcucacagaguuccaaaccuauuaccccacgauuaagaacaucccuuaugauuggaccauuuacuaucugcgcaaaaaggcgcuuacagaaaagaucuccaaggaggagcuggcuuggauucuccugaauuuuaaccagaaaagaggguacuaccagcugcggggagaagagaaggaagagaauaaaaacaagaaggaagaguuccauacccuccuggugacagacaucaucgagcgcgauaaaggcaagagcgggaccugguauaaugugauucuugaaaacggauggaucuacaaaagagagucuaagauuucccuggccgacuggaucggcaaaacaaagagcuuuauugucacgaccgaauauaaugaugacgggucugugaagcucacaaaagauaacgaggaaaagcgguccuuccgcagccccaaagaggacgacuggggacugaucaagaucagaaccgagaaaaccauuaaucagucugauaaguccguuggcgccuacaucuaugacgcccuucugaagaacccuaaucaaaagauuaagggcgaacucgugcggacaaucgagagaaaauacuauaaggaugaacugcgcgagauucugaaaaagcagcucgaauuucacagcgacguccugaacgauaagauccuuuacaaaaagugcaucgacgagcuguacaaaaacaaugauucccauaagaacucuauuaaagaccggggguucgauuaucucuuccuggacgauaucauuuucuaccagagaccccuuaagagcaaaacgucccugaucagcgacuguucucucgaguuccgcccuauuaagaauaagaacggagugcugguuaaagacaccgauggcaagcaaaucgcuaaagcucugaagugcauugcccgguccaauccgaucuuucaggaauuuagacuccugcaguuugugaaaaaccuuaagaucuauaagcgcggggucguggacgauguggaggucacaaaugacuaccugaaaagcgaaaacgauguugagaaacucuucaauuggcugaacgacaaagcggagauuaaucagaagcaauuucuggugaacuucaaacuuaaggaagauaagcaccgguggaauuuuguggaggacaaaggauaucccuguaacgaaaccagaaaucaguuccucaacgccaucgcuaagauugaugucgacaaaucuuucuucaacacaaagaauacccaggaucuguggcacauccuguacagcgugacggacaaaauugagaucacaaaggccaucaccaccuuugcuaagcgccauaaccucccuaaugaauuuauuaucaacuucuccaaaauuaagcccuauaaaaaggaguacggcucuuuuagcgagaaagccaucaagaaacugcuuccucugaugcgguucggguccuacugggaugcgaagaauauugacaucaagacacucgacagaaucgauaaaauucagaccggagaauuugacgagaagauccgcaaccggguuagagaaaaagccauugaucugcacaagaucgacgauuucaaagaccugccccuuuggcucgcuagcuauauuguguacgauaagcauucugaggccuccgacgucagcaaguggaaaacaccggcugauaucgaaaaguuucugaaacacgaguucaagcaacacucucugcggaauccuaucguggagcagguuauuacggaaacccuccgcguggucaaagacaucuggcugcaguauggcgagggcaaggaaaacuuuuucaaugagauucauaucgaacuugggagagagaugaagaacgauaaagccacacgggagaagauuuccaaaaaggugagcgaaaaugagaacaccaaucugagaaucaaagccauucucacagaacugaagaacgacggagucuccgauauccgccccuacucuccuagccagcaagagauccugaagauuuaugaggaaggcguguacaauaacgagucccggaaagaaaaacuugaggaaguugacaaaaucagaaagaacgcuaaacccaccacgucugagauuaucaaguauaagcucuggcuggagcagggguacgcgagccccuacaccggaaaacugauuccuauguccgaacucuuuacaaccaaguaucagaucgagcacaucauuccgcagagccgcuucuuugacgauucucuguccaauaaagugaucugcgaaagcgaggucaacgaacuuaagucuaauaugacagcccuggaguucauucucaccaacgagaauagaaucgugacgcugacaggcggggaaaccguuaaaauuuuuacaaaggaggcuuacaaccaacauaucaucuccuauuacagcaaaaauaagaacaagcagaaacggcugcuuaccgaagagauucccgaacaguucaucucucgccaacucaaugacaccaaguauauuagcaaaaucgugaagaaccugcuguccaaaauugucagagaggaggaugaacaggaggugacaagcaagcacgugguuucucucaauggcuccaucacgagccggaugaagcaggacuggggacugaacgaugucuggaauaccauuguguccccucgcuucgaaagacuuaacacacugaccaauucuaacgacuuuggccaguucgagcucaaaaaggaugccuacgggaacgagggaaaacggguguuucaaacaaccguccccgacgccaucgcuaagggcuucacgaaaaagcgcaucgaucauagacaccacgcccuggacgcgcuggugauugcuuguguuaaucggacacauaucaacuaucuuaauaaccugaaugccaaggauaccgacgacaaagccgugaagcacgaacuccgcaacaaacugugcuuuaagaccaaaccugauagcaaugggaacuacaagugggaguuccauaagcccugggaaaaauuuacaaaggaggcucaggacaaacucaauaccacaauugucuccuucaagcagaacacgagagugaucaauaaaaccguuaacaaguacgugucuuauaaagaugaaaauggaaaccugaaugucgacgccaacggccuuccgcagaagaaggugauuacacaaaccaaaggggauaauugggcuauccggaagccucugcacgccgagacaguuagcggcaaaguguuucucaagagaaucaaacagucccacauuaccaucgcgaacgccauugagcaggucgaacugaucguggacaaggaggugaagaaacagcugaaggcuaaaauuaaacuuuaccccaacaauaucgccggacugaagaagcaucucaaggcuuucccugucaugaucaacgauaaagccauugacaagauccaaauuuaugaaacgcuggaggcgaccgccacacgcaaaauccucgauauuaccuuugacgaaaagaaaauccagaagauuacagauaccggcauccagaagauccugcuuaaucaccugaaacaagagaaguaccagaacacaguugacgagaaugggaaaaagcucgcuccccaugaaauugccuucucugagaacggacuggaagaucugaauaaaaacaucaccuuccuuaaugacggcaagaaccaccagccuauuaaaaaggugcggaucuuugaggaagggaauaaguucccccugggagaggugggcaacaaaauuaauaaguuugucgagacggcuaaagggacaaaccucuucuuugccguguaugaaaaugacgauaagaaaagaaacuacaagaccaucccguucaacgagguuaucgaacgccagaagcaaggccugaaugccgcucucgagauugacgagaacggaaaucggcugcuuuuuacccugagcccuaacgaucugguguauaucccccucgaagacgagauuggcuaccugaauggggucuacuucaaaaaccuuaauaaggaacagacagugagaaucuauaaauuuguuuccuguaccggaggcgaggggcauuucgugcccaacaauuacagcaaggaaauuaucucuaacgagaauggauccaacaauaaaaacgagcgcaugcugaauuuuaacaacuucaauaucauuuuugauggcaaggaaaagccugucaugaucaaaagcauuugcuggaagcucgagguggaccggcuggggaaaguuaucaagauuaucaaauga

SEQ ID NO: 4610 - RNA, 4617 nt, Artificial Sequence
  Cas9 variant
augaagcacauccugggccucgaccuggggaccaacagcauuggaugggcccuugugaaauccgagcaggauugcgacgaugucgaaagaaucaauggcauugaggcugccgggucucggaucauucccauggacgcggcuguucugggagauuucgccaagggcaacacaaaaagccaaacggccgaccgcaccgcugccagagggauccggcgcaugggagaaagacauaagcuccggcgcgagagacugaaucgggugcuugaugugaugggcuuucugccugaacacuacuccgcugcccucacacgcuauggcaaauucaaggacggggaggaguguaagaucgcguggagaaaagaugaaucuggacaguggaccuuugucuucgaggacagcuuucgggaaaugcuggccgauuucguggcucaucagccggaguggcuggccggcgggcgcaagguucccuacgacuggacaauuuauuaccuccggaaaaaggcucuguccaaaccucuuaccaagcaggagcuggccuggcuccugcuuaacuuuaaucaaaagcggggauauuaccagcugcgcggcgaagaugagcacacagacgacaaagggaagcucguggaauauuacgcgcugaaagucgugggaguugaggauaccggcgacaagaaaggcaaggauacgugguucaacaucaugcuggaaaaugggaugguguacagacggcccgccgcugaggccccugacuggauuggaaaaaccaaggaguuuaucgucacaaccgaucucgaaaaggacggcacacccaaaaaggauaaagaggggaacauuaagagaucuuuccgcaugccuaaagaagacgauuggacccugaucaagaagaaaacggagaaugacauugaucggagcggaaagacagugggcgaauauaucuacgacgcgcuucuggccgacccgacccagaaaaucagagggaagcucgugcgcacagucgagcggaaauauuacaaggaggaacugaagaaaauuaucaacucccagaagagauuuauucccgagcuuaaugauaacgaacuguauggacgcugcaucagcgagcucuaccaaucuaaugacgccuaucggcaguccauuagcucuugugauuucaccuaccuguuuguugacaacaucaucuucuaccagagaccucugaaauccaagaaaagccucauugauaauugccccuaugaagaacauucuuacaccgacuccaagacaggcgaggugaagacggcuccugugaaaugugucgcuaagagcaacccccuguuccaggaauuucgccuuuggcaauucgugcagaacauccggauuuuugagagacagaaaaagaucggcgauuccguuaaaaccgacguggaugucacaggggaguucauuaagucugccgacgaugugguuagccuguuugacuuccucaaugaucgcaaagacaucacccaauccgugcugcuuggaacauauuuuaagaucaagaaaccgaagggcaaagacagcgauuacccuuaucgguggaacuacgucgaggacaagaccuaucccugcaaugagacgagagcucugauucucaaagggcugaaggaugccggaaucgacgaaggcuuccuggauaaggacaaagaguacucucucuggcacauucuguacuccguggaagauaagcaggagaucacaaaagccauggaaaaguuugcugccaaaaacagccuugggggcaaguucgcggaggucuuuucuagccugccucccuucaauaagaacuauggauccuacucugagaaagcuauuaagaaacuccuggcccugaugcggaccggcaaguauuggagcgccgacgcuaucgauaaacacacccuugaacgcauugacaagaucaucaauggggaguacgaugaauccauuagaacacgggugagagagaaggccaucaaccucaccgacguuagccauuuucgcggacugccccuguggcucgcuuguuauauuguguacgaucggcacucugaauccaaagacaucacaugcuggaauuguccugccgacauugaucaguaucuggaccauuucaagcagcacagccuuagaaacccgaucgucgagcaagugguuacggagacccugcgcacagugagagauaucuggcggcaguacggcaaaauugacgaaauccacauugagauggggcgcgauaugaagaaucccgcggacgucagagccaaaaugucuaagcggaugaucgauaacgaaaaugcuaaccuccgcauuaaagccaugcuggcugaguucgccgacccugauuuuggaaucgcgggcgugagacccuacuccccuagccagcaggaaaugcugcggaucuaugaggagggggcccuugaauccguggacgagguucccgaugaaauuaaugagaucauuucuaaguucaaccaaaccgacaucaagaaacgcccgacacauggcgagauuaucaaguacaaacucuggcuggaacagaaguaucagagcccuuacaccggaagaacgaucucccugucucggcucuuuaccgacgauuaucagauugagcacgucaucccccaaagccgcuacuucgacgauuccaugagcaacaaagugauuugcgaagcugaggugaaucagcugaaggacagaaugcuuggcuaugaauuuaucaaggcccaucacggggagaaaguccugcucucuuccggagagacagugaccauucugacagcugaagaguacgaacggcugguucagcuuaacuucagaaagaauccugugaaaaugaagaaacuccugauggaugacauccccgauaaguuuauugagcgccagcugaacgacagccgguacaucucuaagaaaaucaagucccuccugagcaauauggucagagaugaaggcgagcaagaggacauuucuaaaaacgugaucgccuguaauggggccauuaccgaucgccuuaagcgggacuggggaguuaacgauguguggaaucauaucauucugccuagauucgaacgccucaacgcugucacgggcagcgaccgguuuacaaccacauccaccaaugggcacaccauccccgacaugccgcugaaccugcagaaaggcuucaauaagaagagaaucgaucaccgccaucacgcgauggacgccauugugaucgcuugcacaacgcggagccauguuaaccuucucaauaacgaggccgccaugucuaaaaacaaugcugugagauaucagcugucccggaagcugcgcagauacgaagauaccauggucacacggaacggagagacccgcacaauuagcguggccagagaauuucucaaaccuuggcccaccuucaaugcggacguggagaaggcucugcggggcaucgucguuuccuuuaaacaaaaccuuagagugauuaauaagacggugaacaaguaucagaaauucgucuacaaugaggaaaagcacaucaaagagaagaaagccgugcgccaggaagagagaaacgggagacaucugcucgccauccgcaagcccaugcacaaagauacaguuuauggagaggugaaucugcggagaauuaaggaagucucucugaaggacgcuguggccaacccuaaagcgguuguggauaaggaccuuaaaaagaaacugauggcuaugaucgagcucggcuacgaucugaagcagauuaccaaguauuucgaagacaauaaagaugccuggcaagacgucaaccucaagaaaaucaagguguacuacuuuaccaaagauacaggggaccgcuauuucgccacccgguuuggaaaugaccugguuacacuuuucagcaagauuacgaaggcugaugacgccaaaaagcagaucgagagaauuaccgauacaggcauccagaaaauccugaagcgccaccucgaagcuaacgggggcgacugccagaaagccuuuuccgcggauggaauugacgagaugaauagaaacaucacccaacugaacggcgggcggccgcauaagcccguguacaagguccgcauuuaugagaaagccgauaaguucgcuaucggaacaaaaggcaauaaggccgcuaaauuuguggaagccgccaaggggaccaaccuguucuuugcuguguaccuuaaagaguaugaagacucuacgaccggagagacaauuaagaagagagucuucgauaccaucccucugaaaacaguuaucgaccggcucaagaauggccagacccccgcgccugaagagaaagauggcgccaagcugcucuuugugcugagccccaacgaccuuguguaccugccuacagaggacgucgugaaaaaugggaccauuaaccgcccccucgauaagagacggaucuauaagaugguuuccuguacgggaacagaaugcuacuacauuccguucaucguggcuucuccuauugucgacaaaguggaguucuuuagccugaauaagaucggcagagccaucaccggggaaaugauuaaagagaucuguauucccaucaagguugaucgccugggaaacauuaccgaagugaauaacgagaaaaucuga

SEQ ID NO: 4611 - RNA, 4623 nt, Artificial Sequence
  Cas9 variant
augaacaagauccugggccucgaccuggggaccaauagcauuggaugggcccuugugggcacagaugaggaagggaaccccaucagaauuuacaaauccggaucucggaucauuccuaugagccaggacguccugggcaauuucgaucgcgggaacuccaucucucaaacggcugagagaaccagcuaucggggaguucgcagacuccgggaacgccaucugcuuagacgggagcgccugcacagagugcuccaccugaugggcuuucugccgucccauuacgaagaggccaucggcugggacaagggggauaauaaaacauucgcgaaguuuuauucugacaccgagcccaaacucccuuggcggaagaacgcugaacgcgagcacgaguuccuguuuaauacacccuacaacgagaugcuuguggauuucagaaagaaucagccucagcuguuuaaaauuaagaaaaacggacaggagagccucauccccuaugacuggaccauuuacuaucugcggaagaaagcccuuuccaagccuaucagcaagaaagaacuggccuggauuauccucaauuucaaccaaaagcgcggcuacuaccagcugagaggggaggaagaggaagaaaauucuaacaaacugauugaguaucaugcucucacagucgugaagguuaucgccgaugaaccgcagaaaggaaaguccgacaucugguacaaugcugagcuggaaaacggcuggguguaucggagaagcucuaaaacaccccuuuuugauugggaguccaaggucaaggaguucgugguuacgaccgaccugaacgccgaugggagccucaaaguggacaaggagggaggcgucaaacgcucuuuucgggugccuuccgaggacgauuggaugcuggugaagaaaaagacagaaagcgacauugagaaguccgauaaaaccgucggcugcuacaucuaugacacaauucuucagaaucccucucaaaagaucagagggaaacugguucgcaccauugaacggaaguucuacaaaaaggagcucacggaaauccugaacaagcagaaagaguuucacagcgagcugcagaauaaggaacucuaucaggaguguaucaaagaacuguacccucacaacgaggcgcauuacgauucccuucuggugaaggacuauacagaucucuucgugaaugacauuaucuucuaccaaagaccccugaaaagcaagaagucucuuauuuccaacugcccguaugaguaccgcgucuaucggaaugauagcggaaucguggaaagaguuccuauuaaauguaucgccaagucucacccccuguaccaggaguuucgccucuggcaguucauccauaaccugcggauuuaugaaagacaacgcgaggugaauggcaaaccugaaaccgacgucgauaucacagcugaguuuauucccaccaccgaggaccgggugaagcuguucgacuggcucaacaauaaaaaggaaaucaaacaggauacacugcuucagagcuacuuuaagauuaagaaaaagaaaggggacgauaaguuccccuacagauggaacuauguugaggacaaagaauacccuugcaaugagacgcgggcccugauccucucccgccugaccaagcugaaccuuucugaagauuuucucacaaaggagauggagcuggcucuguggcacauucucuauagcguggaagacaaagaggaaaucaagaaagccuucaaguccuuugcgcagaaacacaaucuggaugacagcuucgucgaucaauuuaucaaguucccgcccuuuaagaaagacuacggaucuuauuccgccaaggcuauuaaaaagcugcuuccucucaugagaaucggcaaauacugggaugagaaggccauuagcgggaacacccggucuagaauccuguccauuaacgaacgccuggaggacaugcggagcuccggaaagaaaaucgaggaugugucugacgacgauauccccaagcagguccuuaagagcuucgacaaagugaauggcguuuauuccggccucaacacauaccaggcuuguuacgccguguaugggagacauucugaagccagcgagauuaccaaauggaagacgccucaggauaucgacgauuaccugaaugaguucaaacaacacucccugcgcaaccccauugucgaacaggugaucacagaaacccucagaguugugcgggacauuuggaagaaguauggagauuuuagcgaaauccauaucgagcugggccgcgaaaugaaaaauccggcugacaagagagcgaaaaugaccacacagauuucugagaacgaaaauaccaaccuucggaugaagucccugcucgccgagcugaaaaaucacaacgaugucgagaaugugcgcccuuacagccccucucagcaagaaauccugaagauuuaugaggaaggggugcuuaacuccguuagcgagaucccugaagagauuaucaagaucacaaaaucuagccagcccucccagacggagcucgucagauacaagcuguggcuggaacagaaauaucggagcccuuacaccggagagauuaucccccucggcaagcuguucacaucugcuuacgaaauugagcaugugaucccgcaaucccgcuauuuugacgauagccuuuccaauaaagugauuugcgaaucugaggucaacaagcugaaggggaaucuccugggcuacgaguucgugaaaaaccaccacggaguuaagguggaacugaacuuuaauaaaaccgucgagaucuucagcauuaacgaauaugaggaguuugugaagggcaauuacgggaaaaacagaggaaagaugaagaaacuucuccuggaagacaucccuaaguccuucaucgagcggcagcugaaugauacacgcuauauuucuaaaguugugaagggccuccugagcaacaucgucagagaagacggggagcaggaagccaccuccaaacaugugauucccuguacgggaggcguuaccacaauccuuaagcaagacugggggcugaaugauguguggaacaagauugucacaccccgguuugagagaaugaaugagcucaccaacaccucucuguucggccagugggaaaauaaagagggaaagcgcaucuuucggacggaagugccucuggagcuucagaaaggcuucaacaagaaaagaaucgaccaccgccaucacgccauggaugcuauugugaucgccugcgcgacacggagccacgucaccuaccugaauaacgaauccagcaaggcuaaugccaaagagauuagagacgggcucaagcauaagcuguguuuuaaaucuaagacagaugagaccggaaacuauaaauggcaguuccacaagccgugggacaccuucacacaagauguucaggacacgcucgaaaacaucgugauuuccuuuaaacagaaucugcgcgugaucaacaagaccacaaaucgguaccagaaguacgaggaagagaaaaagauccuuaaaagccaagaaaagggcgauucuugggccauuagaaaaccccugcauaaggacaccgucuucgcuaaggugucccuccagaaaaucaagugcguuaaacuggccauggcucugaaggauuggaaaaacauuguggacaagcagcuuaagaaagagauccgccggcugauucucagcuaugggaaguuugacgccgagauccugaauaaauacuucaaggauagaaaauauauuuuuaaggacgucgauaucucuaaaguggacguuuacuauuucgaaacagaguacguggcgacccggaagaaccucgauacguccuuugaccgcaagagcaucgaauccauuacagauaccggaauccagaaaauucugcuuaaucaccugggcgucaagaacaauaacccugagcucgccuucagcgcugaggggaucgacgaaaugaaucaaagaauuguggagcugaacggcggaaaacagcaucagcccaucuauaagguucggauguacgaaccucugggcaauaaauuucaaguggggcgcaucggaaacaagaaggauaaauacgucgaggccgcucccggcaccaaucuuuucuaugccauuuaccagucugaagacaagaaaagaaucuaugauacaauuccucugaacaucauuaucgagcggcagaagaaagagcucuuucccgugccggaaaauaaggaggacaaggauaaccuguacaaacuccuguucuggcuuagcccuaacgacaugguguaucugcccaccgaaaaggagugggcgaauccugaccuguucaacuuuaauaacaugaccaaaaaucagagaaagaaacucuacaaguucaucgauggguccggaacgaccgccaacuuuauucccaauacagucgcuaacaucauuuucucuaucccgaagaaagacagcggcaaguauuccauggggaaucgcauuguucaaaacgaauuuggcaucggaucuccucagagcaaaaaucagaaggccuucaccggcgagaugauuaaagagcgguguuggaagcugaaaaucaacagacuuggggauaucauugaaugcaucaaguga

SEQ ID NO: 4612 - RNA, 4629 nt, Artificial Sequence
  Cas9 variant
auggagaagagaauccugggccucgaccuggggaccaacagcauuggaugggcccuugugaaaggcgaacggcacgagaaugauaacgaaacaauccuguccuacauugaggcugccgggucucgcauccucccccuggacgcggcugcccagggagauuucgaaaagggcaauccugccaaaacgcaaaccagcgagagaacacggaugcgcgggaugagacaucuucuggagcggucccuccugcgcagagaacggcugcaccgcguccucgacauuauggauuuucugccgccccauuauucucagagccuuaccagauacggaaaguucaaagcugacacagagugcaagcuggccuggcggaagaccgaaacaggccacuaugaguuucucuuccaggauuccuuucaggagaugcugcaagacuuccagaaccauggcaaacuugaagagaauaagaaaaucccuuacgauuggaccaucuauuaccugcgcaagaaagcucucacgcagcccguuucuaagcaggaacuggccuggauucugcucaacuuuaaucaaaagagaggguauuaccagcgggaggaccaggcgguggaugacaaccagaaaaagcgcguggaauaccaagcccugaaagucaucagcguggaggauaccggagagaagaaaggcaagaauacaugguaugacguuagacuugaaaacgggcugguguaccacuauuccgcuccuauuaaacccgacuggaagggagagaccaaggaguucaucgucacaaccacgauugaucagaauggcaaaccugaacucgacaaggaugggaaaccgaaguacagcaugcgggcccccaaagaagacgauuauaagcugcuuauggagaagacaaagaaggacaucaccgauucuggaaaauccgugggcgaguacauuuaugacgcucugcucguuaacccucagcaaaagaucagaggcgggcuggugcgcacaaucgaacgguacuuuuacaaaaaggagcuggaaaagauucuccugagccaggagagauucauccccgaacuuaccgaucgcgagcuguaucggagaugugucgaggaacucuacccuucuaaugacgccuaucgccaccugauugagucccgggauaugagauaccuucugguggaagacauccucuuuuaucagcgcccccugaaaagcaagaaaucucugauugacgauugcccguacgagucccggagcuauguggacagagagaccggagaaaucaaguccucuccugucaaauguaucgcgcagagccauccccucuuccaagaguuucgccuguggcaguucauucacaaccuucggaucuaccagaaugaaagauccguugagggcaagcugcagcucgauguggacgugacagaagagguccugccuacgcccgagagcaaggccgcucuguuccgguuucuuaacgaucgcgaaaacgugacccaagagauucuccugaaagaaguuuucaaggggagaaaacugucugugaaggacugccccuaccgguggaauuaugccggagagggcaaaaaguacccuuguaacgaaacaagacaucucaugcugaaacuucugaagaaggcugggaucgauaccgccuuucucacaccggagaaagagcaggcccuguggcacauuauguauuccgucgaagacaaggaucaguacgagaaagcucugagcaccuucgcgcgcaagaaugaccuucccgauggauuuaaagaacaguucaagaaggccccuacguuuaaaaaggacuauggcgcuuacucucuccgggccaucaaaaagcugcugccccucaugagagugggcgaguauuggagcgccgauugcaucgacuccgaaacaaaagagcgcauuucucaaaucauuagaggggagauggacgaaaagguuagccagcggaugaccaagucccgcgauagcuucaccgacaucucucaguuucagggacugccuguguggcaggcuuguuacgucguguacggcagacacuccgaggccacagaaauucaacggugggagaaacccgaggauaucgacgucuaucuuaaggcguucaaacagcauagccugcgcaacccgauuguggaacaaguugugcucgagacccugagagucgugcgggauaucuggaagacauacgggaaaguugacgaaauccacauugagaugggacgcgauaugaagaauacggcugaagagagaaagcggaucuuuaaccgcaaucagcagaacgagaaugacaaccugagaauuaaagcccuucucaccgaguucaugaauccugauuuugaaaucgaaggcgugcggcccuauucuccuucccagcaagaggcccugagaauuuacgaagacggggcuuggagcggccuggaugaggagaaggaagacaaaaaggagcucgaagccauccgcgagauccugggaaaauucucccagucugauaaggcuaaacggcccacacauagcgaaguccuuagauauaaggccuggcuggagcagcgcuacuccucuccuuauaccggcgaggcgauuccccucgccaagcuguucacaccggcuuacgaaaucgagcacgugauuccucagagccgguuuuucgacgacuccuuuagcaacaaagugguuugcgaagccgaggucaauaagcugaaagauagaaugcuuggguacgaguucaucaaggcucaucaaggagaaguggugucucucuccggcaccgggcgcugugcccggauucugagccccgaggaauaugagcagagagucacggacugcuacaaacacaacaccgcgaagaugaagaaacugcucauggaagagauccccgaugacuuuauccagcgccagaugaaugauucucgguauauuuccaagcuggugaaaagccuucugucuaacaugguuagagaggaaggagagcgggaagccaucagcaagcacgugauuacauguaacggcaccaucacagaccgccucaaaaaggauuggggcgucaaugacguguggaaccauauuauccugccuagauuccaacggaugaaggaucugaccgggcgcaaugacuuuguugcugugaacucccagggacacgagaucccgagcgugcccccugaacuucagaaaggcuucaagaaaaagagaauugaucaucggcaccacgccauggacgcuaucgucauugccugcacgacaagaaaucauguuaaccugcucaauaacgaggccgcuaugucugagaauaaagcgaaccgcaucgcccugucccggaagcucagacgcuacgaaaauugcgcuauuuauaaagggggagagaccaaaaacaucagcguggccaaggaauuucugaaacccugggccacauucccugcugacgucgagcgggcccuuggcgauauugugguguccuuuaagcaaaaucugagagucaucaacaaagcgaccaaucacuacgaacauuauaaggacgggaagaaaguuaaggugccccagaaaaagggagauaugugggugguccgcaaaccucuccacaaggacaccguguacgcucugguuaaccugcggaacgugaaaacagucggccuuaaggaugccauccugaugcccgacagaauugccaauaaggaucucaaaaagaaagugaaggagcugcucgcucagggggacgaucugaaaaagaucaagaaauacuucgagacggaaaaggacaccuggcaggauguugacgugaaaaagauugaggucuauuacuuuucugaagagacagccaaccauuauuacgcgacccgcaaaccguucgaugcuaaugugaagaucgacagcguuacagacaccggcauucaaaagauccuuagacggcaccuggaggaaaacggaaauaaagccgauguggccuucuccccugagggcaucgcucgcaugaacgaaaauauuuuuagacucaacgggaauaagcaccaucagcccaucuauaaaguccggguguacgagaaggccaacaaauauccugugggacagacgggcaauaaggcuucuaaguucgucgaagccgcgaaagggacaaaccuguaccuggccguuuacgagagcgaggugguggacaagaaaaccgcugaaauuuccaagaaacgcucuuaugucaucgugccccuuagagaugccguugcucggcagaagcaaggagugccggucgccccugagagaaaugaagagggcgggaaacugcucuuugugcugagccccaaggacuucguuuacgugccuaccgaagaggagcgcuccaagggcgaaguccuccugccccuugauaaaaaccggauuuauaucaugauggacgccagcgauggaaucgugaauuuucugcccuacucugucgcuaaccugauuuaugcgcucccuaaggaccaggccuccggcuucuguacagaugggagaaugauccagaacgaguuuggacugggcagcccgaaaucuaagaaugaacgcgcucuuaccggggagaugauuaaagaaaucugccugcccgugaagguugaccggcucggaagaauuacagagaucaacggcaauaagguguga

SEQ ID NO: 4613 - RNA, 4644 nt, Artificial Sequence
  Cas9 variant
augaagaaaauccugggccucgaccuggggaccaacagcauuggaugggcccuuacaaauaacgauuucgacaauaagcugggcuccaucgaggggcucggaucuagaauuauccccaugagccaggaugugcugggcaaauuugacuccggggucucuauuagccaaacggcugaacggaccaaguaccgcggaacaagacggcuuguucagcgcuuccugcucagacgggagcgccugcacagaauccugaacauccucgauuuucugccucggcauuauuccgaagccauugacuucgauaaaaaguuuggccaguucaagccggagcgcgaagagaaacuuucuuuuuacaagaaugagagcggcaaaaaccaguuccuguuucucgaaucccaccaagagauguucagcgaauuuaagcugacccaucccgaccuuaaacaggugccuuaugauuggacaaucuacuaucugagaaagaaggcgcucacccagaaaauuucuaaggaggagcuggcuuggaucauucugaauuucaaccagaaacggggguacuaucaacuccgcggagaagaggaagaggugaauaagaacaaacuggaagaguuucacacacuugucaucguggacguuauugagagagaaaagggcaaauccggggugugguacaaugucauccuggagaacggauggaucuacaagcgggaaagcaagauugcccucuucgauuggaucggcaaacagaagaauuucauugugaccacggagcugaacgacgaugggaccaucaaacuuaauaaggacaacgaagagaaacgcucuuuuagaucccccaaggaggacgauuggggacugcggaagauuagaacagaacagaccaucaaccagagcgagaaaucuguuggcuccuucaucuaugacgaacuccugaagaaaccuaaucaaaagauuaaaggcgagcuggugcgcacaaucgaacggaaguuuuacaaggaugagcucagcaaaauucugaaggcccagaucaccuuccauuaugagauucuuggggacagaaacaucuacaaaaagugcaucgaugaacuguaucgccacaaugacucccacaaaaacaauauuaaggauaagggauuugacuaccucuuccuggaugacaucauuuucuaucagcggccccuuaaaucuaagacgagccugaucuccgauuguagccucgaguucgucccuauuaaagacaagaaaggcauccuggugaaggacucuaacgggaaacaaguggucaagccgcugaagugcauugcuaaauccaaucccaucuuucaggaauuuagacuccugcaguuuguuaagaaccuuaaaaucuacaagaaagagauuaucaaugagauugaugugacaaacgacuaccugaagaccgaagaggaucucguggaacuguucgacuggcugaaugauaaggccgagaucagccagaaacaauuucuugcuuauccuaaguucaaacucaaggaagacaaauaccgcuggaacuucgucgaggauaagauuuaucccuguaaugagacacggaaccaguuucugaaugccaucgcgaagaucgacgugaacaaaucuuucuuugaugccaagaacacccaggaccuguggcauauucucuacagcguuaccgauaaaacagaacuguucuccaucaauacggagaccggcauucagucuggagcucuuagcacauuugccaagagacacaaccuguccaaugaguucgugagcaacuuuucuaaaaucaagccuuauaauaaggacuacggguccuauagcgaaaaagcuauuaagaaacuccugccccugaugcgcuucggaucuaacuggaauaagaacaauaucgaugccaaaacccuugcgcggaucgacaagcuccaaacaggcgaauuugacgagaccaugagaacgcgcguccgggagaaagccauucaucuguccaagaucacagauuuccagggccugccgcucuggcuggcuagcuacauuaucuacgacagacacuccgaagccucuaacauuagcaaguggaaaaccccugaggauaucgcuugguuucuuaaucccaagaacaaauccggguucaagcagcacucucugcggaauccuaucguggaacagguuauuaccgagacacuccgcguggucaaagacaucuggcaacauuauggagaaggcaaggagaacuuuuucaaugagauucacaucgaacuggggagagagaugaagaacaacgccaaugaucggaaaagaauuaccgaaacaaucaaccagaaugagaacacgaaucugcgcauuaaggccauccuuaccgagcucaaaaacgacggaaucaaugaugugcggcccuacagccccucccagcaggaaauucugaagaucuaugaggaaggcgucuacaacagcgagauuagaaaagaaaagcuggaggacaucgauaagauucgcaaaaaugcuaagccuacaccgucugagaucaucaaauauaagcucuggcuggaacaaggguacauuucccccuauaccggcaaacuuaucccucugagcgaccucuucacaaccaaguaccagauugagcauaucauuccccagucuagacuguuugaugacucccugagcaacaaggugaucugcgaaucugagguuaaugaucuuaaaggaaacaauacggcgcucgaguucauccugaagaacgaaggccggauugugcugcucaccgggggaaaaacagucaagaucuuuaccaaagaggccuacaaucaacacauuacaagcuauuacaucaagaacaaguccaaacagaagcgccugcuuaccgaagagauuccugaaaaauucaucgacagacagcugaacgacacgaaguauauuagcaaaaucgugaagaaucuccugucuaaaaucguucgggaggaagaugagcaggaggugacauccaagcauauugucagccugaacggcuccaucaccucucgcaugaagcaagacugggggcuuaaugauguguggaacaaaauugugagccccagauuugaacggcugaaugcuaucacaaacuccaaugacuucggaaagcucgagcugaaaaaggaugaauuuggcaacgccgggaaacagguuuuccagaccaccgucccggacgauauugccaagggcuuuucuaagaaacgcaucgaccacagacaccaugcucucgaugcccuggugaucgcguguauuaaucggacacacaucaacuaccuuaauaaccugaaugcuaaggacgagaacgauaaaacgauuaagcaugagcuccgcaauaaacugugcuucaagaccaagccugacagcaacggaaauuccaaaugggaauuucacaagcccugggagaacuucacaaagaagguggaagacgagcugaaccagaccaucauuucuuucaaacaaaauacaagagucaucaacaagaccgugaauaaguaucagguuuggaaagaagaggauggcgccaugaagaaagugacggucaagcagacaaaaggggacaacugggccauccggaagccuauucacgcugagaccgugagcggaaaaguuuuucuuaagagaaucaagcagucccauauuaccaucgccaaugcuauugaacaaaucgagcugauuguggauaaagaaguccgcaagcagcucaaagccaagaucaaacaguaccccaacaauaaggagggcuucaagaaacaccugaaggcguuuccuaucaugauuaacgggaaagccaucgacaaggugcaaauuuaugaaacaaucgaggcuaccgccacacgggagagaaauaaccucgauauuacguucgacgagaaaaagaucgaaaagaucaccgauacaggaauccagaaaauucugcuuaaucaucugaagcaggaaauuuaccagaacgcuaucgacgagagcggcaaaaagauugcgccccacgaaguugccuuuucugagaucgggaucgaugagcucaauaaaaacauuaaggugcugaauaacggcaagaaccaucaaccgaucaaaaagguccgcauuuucgaagaguccaaacgguuuagccugggacagucuggcuccaagaccgacaaauacguggaaacagccaaggggaccaaucuuuucuaugcuaucuacgagggcaaaaagggaaacagaaauuauaagacgauuccucugaacgaggugaucgaacgccagaaacaggggcucaauagcgcccuggucaccgaugagaacgaaaaucggcuccuguuuacacuuucucccaacgaccugguuuacauucccaccaaugaggaaaagaaaaaccugacaaccaucaauuucgauaagcucuccagagagcaaacagagcgcaucuauaaauuugugagcuguaccuccggagaaggccacuucgugagcaacaauuacucuaaggagauuaucagcaacgaaaauggguccaacaacaagaaugagcggaugcuggaauuuaacaauucuaacacgauuuaugacgagaaagagaagccugucaugaucaaaagcgugugcuggaaacuugaaguugacagacugggcaaaauuaagcggaucauccgcuga

SEQ ID NO: 4614 - RNA, 4677 nt, Artificial Sequence
  Cas9 variant
augaagaaaauccugggccucgaccuggggaccaacagcauuggaugggcccuugugaaugucgauaagaacggcaaucccuucgggaucgagggacugggcuccagaauuaucccuauggaccaggcuacacucucugauuuugaaaaagggaacagcaagucccaaacggccgagcggaccauguuccgcggagcgagacggcugcgcgaaagaaaacaccuucggcgcgagagacugcaucggauucucaaugaacugaacuuucugccgauccacuaccgcucuugcaucgacuucguucauagacucggcaaguuuaaggcuaaucacgagcccaaaauugccuggcggagcaacgaucaggacaagauggaguucaucuuucaaaauuccuuccuggaaaugaugucugauuuuacaaaacgccagccugagcuugugaaggaaggcaaaaagauucccuaugacuggaccaucuacuuccugagaaagaaagcccucgggcaacggauugagaaggaggaacuggcuuggcuucugcuccauuuuaaccagaaacgcggauauuaccagcugagaggcgaggaugaaaucgacgccacacggagcgcuaagaccagaaaauauuucgaucgcaagauuaucaaauccaucauugacacaggggaggaauacaagggacugaaggugcucaucgucgagcuggauaauggcaaccaggggaaaauuuuuaagcaagaggugccugacuggguuggacaggaaaagaauaucauugccaccguggaccuugauaaggacggcaaagaucgguucgacaagggcguccugagccagagauucucuauccccuccgauagcgagugggaaacggaguggaagcucaucaaacugaagaccgaagaggaccuugaggcgucucagaaaacaguggggaccuauauuuacgauucccugcucaagaacccuaaucagaaaaucaagggaaagcugguucgcacaauugaacggaaauacuauagagacgagcugcgcgccauccucaacaagcagcgggaauuucacccggagcugaacgauaaaaagcuguaccagcacuguauuuucagccuuuauccccaaaaugaggcuuuuagaaacucuaucgccaauaaagacuucaccuaccucuuucuggaagauaucauuuucuaucagcgcccucuuaaguccaagaaaagcacgaucaacaauugcgcuuacgaggugcggagauauauggacaaggaaacaaaagagcugaaggaagucccccucaaauguauugccaagucccauccuaucuuucaggaguuccgccuguggcaguuuauuucuaaccugcggaucuacaaaaaggacauuaccgauaucgacgugacaaaugauuuccuccacagccaagacgauuacgcgaaccuguuugaguggcuuaauaacaagaaugaaaucgaccagaaagccuuccugaaguaucccgcuuuuggcuucaaaaaggaugccgugaacuacagauggaauuaugucgaggacaaauccuacccgugcaacaagacccggagcgcuauucucucuaagcuggauaaacaugaacaggaguuccugaccaaggaacuugagcucaaaaucuggcagcugcuguauuccguuaauagcaaggaggaaauugacaaagcccucaacgugaacucuccuaagaucaauaacaagauuagcaucgaucacacagggauccugcacgagcuuaaauccucuagccuguccgacauuagcauccaacgccucaaggccauuaauuuugaagagaaagauuacggaucuuauuccuacaaggcuaucaaaaagcugcuggcgcuuaugagacagggcaaguacuucgacaacacggccauuaccgacgcuacaaaagcccggaucaauagcaucuuugauagacucgaaucuauuuccuucgaccccgagcgcaucaacagcauuuccgaugacgauaucccuaagcagauucugaaaucuuuuaucaagcugaaucggaccuaugggggauucaacacauaccaggccuguuaugcuguguacggcagacauagcgaggccaaagaaaucgcgaagugggagaaacccgaagacauugaucaauaucucgcuaaguuuaagcagcacucccugcgcaaucccaucgucgagcagauuaucaccgaaacgcuuagagugguucgggacauuuggaaaaagcaugccuacaaaacaaucaacaaggauaaucagggcaacaauugcgagucugagagcgaacugaccgagauucacaucgaacucgggcgcgacaugaaaaacaauaaguccgagagacugcggaucagccgcauuaacucugagaacgaaaauaccaaccugagaauccggaaacuucucauugaguucaaugauccugaauuuggaguggagaacguccgcccgcauucccccagccaacaggaaauccugagaauuuaugaggacggcgugcugaaaucugggguugagaucccugaauacguggauaauaucauuaagaaauucaaggagacagacgucaaaaagcagcccuccaagagcgaagugcuccgguacaaacuguggcuugagcaaaaguaucgcucuccuuacaccaacgaagucaucccccugggaaaacucuuuacaaaugacuaucagauugagcacaucauuccgcagagcagauacuucgaugacuccuuuagcaacaaggugaucugugaggccgaaguuaaucagcugaaagagaacgaacugggcugcgaguucaucaugaauaacgggggccggauuguggaacuuucuuucggaaagacggucagaauccucgauuuugaggcuuaugagcaauucgugcagcagaauuacgccggcaaccgcccuaagcugcggaaucugcucaugaccgaaauucccaacgacuuuaucgauagacagcugaacgacucccgcuauauuagcaaaguugugaaggggcuucuguccaauaucguccgggaggauggagaagcugagucuacaagcaaaaaccucauuuccuguaccggcggggugacagccagacugaagauggacuggggacugaaugauguguggaacaaucuuaucuacccucgcuucgagcggcugaacgaacucaccaauucuaaccaauuuggcuacugggacaaaaaggaugggaagaauguuuuccagacgcagguccccauggacauccagaaaggcuuuaacaagaaaagaauugaccaccgccaucacgcgcuggaugcccucgugaucgcuugcgccacccggagccauauuaauuaucugaacaaugaguccgcuaagucuaacagcaaagaauccagauacgaccuucggcgcaagcugagacggcucgaggugauccaaaaagaauauacaauuaauggacgcaaggagaucagaaacaucgaggucgccaaggaguucuacaaaccuuggaauagcuuuacccaggaugcgcagucugcccuggaaaacauugugguuuccuucaagcaaaaccugcgggugaucaauaaaacaaccaacuauuuucuuagauucaauaaggaaggcaaaaagauuuucgagacgcagacaagcgggucuaacugggcuauccgcaagccccugcacaaagacaccgccuuuggacucgucaaucugaagcggacaaaaaccgugucccucgcuaacgccauucuggauuacgaccagaucguuaauagaaaacuuuggaccaagaucaaggaacugauuagcaucggcuaugauaacaagcgcauucucaaauacuucacagacgauaaggagaauuggaacgagaucauuucuuccgggaucgaaguguuuuacuauacggacaauuucgagaaacaggucgccacccggaagccgcuggauaccagcuuuacagaauccaaaauuaucaacagcaucacagaccugggcauucacaagauccuucuggcucaucucagagcgaaugagggaaacccuaauauugccuucucucccgaagggaucgagaccaugaaccgccacauuugugagcugaacggcggaaaguuucaucaccccaucuacaaagugcggguucaugaaccucucggcuauaaguucaaagugggggauaagggaaauagaagcacgaaauacgucgaggcugccaagggcacaaaccuguuuuucgggaucuauauuaauucccaaggaauccgcucuuacgaaaccauuccgcuuaacguggccaucgagagacagaaacagggccugagccccgugccugacaauaacgagcugggggaacggcuccuguuuuggcuuucccccaaugaccuggucuaucucccuaccucugaugagguugaaagcggcauuugcugcaacaagcugggaaucgaccgcaucuacaagaugguguccuguacaggcuacgugggggauuucauucccgcucacaucgccaauccuauuauccagacccucgagcugggaucuaacaauaaagcgcaaagagcuuggacaggcgaaaugauuaaggagaucugcauucccgucaaaguggaccggauggggaacaucguugagaucuuuaaucgcaacaagaauuga

SEQ ID NO: 4615 - RNA, 4695 nt, Artificial Sequence
  Cas9 variant
auggccaagauccugggccucgaccuggggaccaacagcauuggaugggcuaucguggaugacaaaaauuccaagauucuugauacaggcgucagaaucuuccccgaggggguuguggccaaaacgauuggaucuggcgacaaggaagagagcaaaaacgcgaagcggcgcgaauccagacagacccggcgcggguuuuacagaaagcggcugcgcaaaaucaagcuccugagaacacuuaucaauuucaaaaugugcccucuggagcacuuugaacucgauguguggucuaagugggacaaaauuaagaagaaagagggacggauggcuccggagcuguuccugcccgaaaacagcgccuauaaucucuggcugaagcaaaacccuuacauccuucgcgauaaagcccuguccaaggaccucacccugacagaguuuggcagaguccuuuaucaucugauucagcggcgcggcuuccucucuaauagaaaagggaaggaugacggaaaaaucuacggcgggaaggaaggaauugugggcaucgauaagaccaacgagcagauuaaaaauagcacacuggggaaguuucuguucaaaauccuccccaaggagggagaaccuuuuaaaaucauugaggacgaacugggcaacgagcuucggguucgcuccagauauacccugcgggauauguacaucgcugaauuugaggccauuuggaauagacaggcuaagcaccucggccuggacaacaucuauuacagcaaugugaagaacguccuucugaaagggucucucaagaauaaaaagaacgagcgcaaaauuaaccaucugaagaagaucaaaggaaauggcaacaucgaaauuaucacgcugaauaacaaucucuccaagaacgagaaacccaaguaccugcuuaaaauugccaccaagcugccucucaaggaauuucuggcggggcggaucgagaaagacgaagauggaaagauuaaauucaagagcaaugagucugugcuuuucuggcaaagaccgcugcgcucccagaaaaagcuccuggccaaaugucgguucgagcccgaccugaaggaugacaacggcaaguucauccagaaagggaagacaccuugccaccucagccauccccuguaugaagaguacagagcuuaucaguacguuaauaacaucgaauauggcaaaaagcaacgccuugaggaaucucagcggaaacaggugauugaucugaucaauuccaaggacggaaacuuuaaguucagcgagauuaaaaagaaacucaagcuguccuacgagaccuuuaauuauucugaugacagcuccgucaacggcaauuacaugaucaaaaaccugaacagcauuuucccuaaggaaauccuugagaaggaauuuguggugaaugucaacaaagaggauauuaucgaguacggguaugaaagaaucuggcaccucuuccacuuuugugaggacaaugauguucugauuaagaaacugcaggacaacuucgaccucucugaaaaugauaucgagaagauuuccaaaaucaaccugaaggaaggauacagcaaugugucucuuaaggccauuaaaaacauccugcccuaucucaaggagggcaaacugcugagcgacgcugugauccuugggggaguccgcaauguguuuggcaagaaauggcaugaguucauugauuuucacgaaaagaucgagaaagacauucucuacaucaaccaucaaaaguccaauaaggaaggggaggccauugagaaaaucaagaaauaucugaucgauuacaaguucggcuuuacagaaaacgacaaucgguucaaaaagcuguaucaccacucucaggauguuguggaggucaagcuccagaaaaagauuggaccgguggaagaccugagaaacccuaucguucaacagggcgugaaugagguccgccggcuugugaacgaacugcucgauguccaugggaaauucgaccaggugagaguugagcugggacgggaucugaagaacaauaaaagcaagcgcgaagagauuggcuacaagaucagagagaacaccgcgaaaaaugaaaaggccaaagagcuucucauugaauacgggcugcggcaguccagagacaacgugcaaaagguccugcucuuucaggagaugcuggaucgcggaacgguggcuguuugccccuauacaaauaaaaccaucaacaucagcgacgugcuuggcaaugagaacaagaugcagauugaacacaucauuccuaagucuaucucccuggacgauagcuucgccaauaaaacacucugugacucuaaguuuaacgggcugaaaggcgagcggacccccuacgaguucuaucagauuaauaacgaugcuaaucuguggggaggcuccaagagcugggaagaaaucgagagacgcaccuuucggauucuucccuacuccaaagccaagagauucacaucuaagacgaaauuugagaccaacgacuucauccaacgccagcucaaugauacaagauauaucagcaagaaaaccaaggaaauucugucccagaucugcgaggacguccgggugaugccugggucucugacagccgaacuccgcaaacuguggggacuuaacaacauucugcauccggcuuuugugcucgaucugcccgcgcugcacaucgacgccaauaagcauauuccucacuacguuguccuugaugaggacaacgugcccauccugagccagagaaucuauaaugauaaaccuauucucaaggcuaaccaaaccuccaucacgggcuucguggacaaugaaauuuuuaagagcaaagagaaguacgucaaauucgaggugaaggcccccaaccugucuaauggggaauacugggccaaacuccugcuuuccaacccgaaaagcaucguucggguguuuaaggagaaaccuaagucuacagaaaaugagauugucgugcgcggaaaaaucgaaaaggagaaauucaagcacgagggccuguccgggaucaacgcugaaggcaaggagaauggaaccuauugggccaaacucagcauuguugauaagaaauucaagaaacccaagaaggacgaccagccuaaaaagaacggcaaacagauccugcuguuuggggcggugaaggaaggagucuucucuagcuacauguaugagugugaugcugaccuugaggauggcaaauacuggcugauucucgacaucgauuuugaaaauguggaguucgaaaaggcccugaacgagagacccgaaguucucgagaaucagauucugauccaagggauuaccaacgacgagaauguguuugucuccgauauggacugccagcaucaguuccuuaugaacgaaggaaaaggcaaguauuacgugcuguuugauaucaucagcgaggugaacgaguucuauccuauuaagacaaaaucucccgaacucgaaaaugggcaaucccugaccgagggcacaaucugggucgacaaguacacgggagagauuaaauuugauccgaagaaaaaccgggaagaccaccgccaucacgccaucgacgcucugguuauugcccuuaccaaggagacauacuuccagcagcugagcagacggaaugcuuccucugaaaacaagaaaagaggcaaugaguaugaaaaggagcagcucgauuuugccgagccuuggaaagaguuccacguggacgcgcaaaagagcaucaacuccauccugauuucucauaaacagaauaagaacauccucaccaagauuacaaagaagaucaccaaaaaugggaagacguacaaaagcgaaggaauguccgugcgcggccagcugcacgauaagaccuauuacgggcauaacaagaauuguaaagccgacgaauaugucuaccggguggauauuaacaaucuuucuuucagccagcugacaaacaucaucgaccugaaucucaaggcuguuauuguggagggagucaucaaaaaguuugaggaauccgagaaacugcuuuucaagaaaaugaacagcaaggugcaaaaccuggauaagucuaaaguuaagaaaauuaaggccaaaguggacaagauccucaaggaaaccuccuuuuucaugcccaaugagggcaaaagauauauucgccugaacaucauugaacccgcuaauuuugagcggaugccugucccgaucaagaaagugagaauccgcaagguucuccggaacgccgagaaacugaauaacgaaauuaagcaguucguggauccccagaauaaccaccauguccuuaucuacaaggacgagaauggcaaccugaaagaagagguggugacauuuuggaccgucguugaaagaaagcgcacgggggagccuguguacaaacugcccagcgauggaaagaaaauugugacaacccuccagaucaaugacauguuccugcuuggccugaacgaggaugaaauuaauugggagaacccuaauuauaaccaccucaaggaacaccuguaccggguccaaaaguuuacaucuggggacuucuauuuuagaaucgcgaaaaccuccagcauccagaacggagaggaaaagcagcaaauuaauucuuucggccucgggaaaaacggauggcugacccauaaucccaucaaggugaaaauuuccguuagcggcaagauccuuaagguguga

SEQ ID NO: 4616 - RNA, 4713 nt, Artificial Sequence
  Cas9 variant
auggagaacagcaauaacuccucuaagaaauacuaucugggccucgacauggggaccgauagcugcggauggugugugacagacgauaaguacaauaucauuagaucccacaaaaagaucuauggccccgacgggaaacuggucaagcgggaaggaugccaucuuuggggcucucgccuguucagaccugccaacacggcuaagagccggcgccucaauagaaccgcccggcgcagacuggcgcggcgcagacggcgcauuauccuucugagagagcucuuucagccggaaauugauaaaguugaccccaacuucuuucggcgccuggaucaauccaaucuguggaacgaggacaaggauaaagaacuccagauggagcacaauuuccuguuuaacgacaaggaucuuacagacaaagaguacuauaaggauuucccuaccaucuaccaucugagaaaggcuauggugaaugggcucacaaucaacggauauuacuacgaccccaaaaagcaguuugacauucgggaaguguaucugguccuugcccacaugaucaaauacagaggcaauuuccugauggagggcgaugugaaggacucuguuguggauccuaccuaucucaaacaguguuuugacaacauugaugucauccugauuagccugaauaacggggaagacgaugagaacgaggacgauaagaucgaccccuccgaaugcuguuucaauguggaugagaaaaaggcccgcaagcucgcuaacaauuuucaagaaacaaacaaaguuagcgaccuggaggacgaugaacgggaccuuuucggaaaguuuaauucuaaagauauuagaaagaaaauccugaagcucaucaacggcggguccggagugaagcugaaagacuuccuuccuaaggagauucuggucgcccaugauggcgacgaugaguacggggacaaaaagaucgaucucagcucugaaacccuggaggacgauauuaauggauauucccugccggaaagcuacguggagaucauucucgaagcuaaaaagaucuaugacuucaagacgcuggccuaccuucugcacggcaaaucucuccugugcgaugcgauggugaacgucuacgaggagcacaaggaacagcuugccgcucugaaacgccucuauaagaaauacgccaccaaggagcaguauuacuuuauguuccgggacuccagaauccuggacggcgaugacagcgaugacgaagaggauaaggaagaguccaauaaagaggaaucuaaggacaaaaagaaaaaggcuagcuauguuuccuacauuggguauacaaaaaccaacagcaaggccaaguacacaggagcgcauaucaccucugagaaaaauauuuccgcccugaucaagcagauuaaagaugaccucaaguuugaugaccugaaaagcaagguggaugaccccucucaacagaacgaacuuagcgaugaggacaagcuggacauccaguguaucgaggaagcuauugaguccaauacguuccucccucgccagaacucucggaauaacggcgccuuucccuaccaacugaaccugaaugaaaugagaacaaucauugagaaccagagcaaauauuacccuuuccuuaaggauaaagcucccuccuuuccggacgggaagaccgaagaguauaaaaucgugagccuccugaaguucaagauuccuuacuauaucggaccccugucucagccuaaugauuacguccgcgacgauaaacgggacaaccacugggugcaauuuagaggcgagaauaaccaggggauuaucaaucccuggaacuucucccagaucguugaucucgaaggaacagccgacaaguuuauuagcaaucugaccaacuauugcaccuacaucuucggcgagaauacacuucccaaagaaucucugauuuuucaggccuacaaggugcucaacgaucugaauaaccugaaagucaauggcucccuuaucagcaaggaggacaaggauuauauuauccaaaacguguaccucaaaaagaaaaagaucaaagggaaggacauuguuaacgcucugaaaaauaaguauaagcuguccgacgaagauccuacggugaccacaaaaggaucuggcaagagcaucggggaggacgaggucgaucucaccauguucaacuccucucugagcuccuucauugacaugagcgauccgaaugcguuuggacccgaguucuacaaagacucuaacaaguuugaacuugccgaaaaagugaucgagcugauuacaaucgucgaagauaaggaccuccugaaggagcgccugaaaaagcucggccuuuccgauaaucaggugaacuaucuguucaaacagaaguacagcgggugggcuccucugucucggaaacuccuggacggcaucaccauugauuguguuaaugagaacacgggagaagccuaucccgugacaaucauugacgucaugagagauaccccucuuaauuuuauggagaucuacgaaaccaaggagucccaguucagcggcuuuaaggagaaaguggccgaacugaacgacgagaagaaacucucucgggacgaucugauugaagagagcuacgcuucccccgccaugaagcgcagcguuagacaaacauucaaagugaucgacgaacugaagaauacccuuaacaucgaucauuuugaccggauuuucgucgaggcgacaagagcuccgggggaggccggaaagauggugaaaucucgcaagaaacagcuccaggaagccuaugaugcugccaaggaccugguggaucaggagucccgggacgaucugcaaaaacucagagacgaucuggaaaagcagacggacgaucagcuucgcagaaagaaaguuuaccuguauuuuaugcagcucggccggagcgucuacuccggggagaagaucgaccugaaugaacuggacaaaaacuaugauauugaccacaucauuccucaagcuaaacuuaaggaugacucuuucaauaacauggugcugguggagcgcgagcucaacaauaagaaacaggaugaauaccccaucccuagcaccauuaucuccgagcacggaagaaacuggauccagaagcuggccaagauucaagacaaaaauaagcggucuuauuuuaugcccaaagauaaggcgaaccgccuccugagaccugaaagcaaacagcuuacauccgacgagcugaauggcuucaucaaccggcagcucacccugacaaaucagucugucaaggccgugugcgauauucugaagaugaccgaaaaagggagcgagaucguuuacuccaaggcuaacuucgugagcgacuuucgcaaacuuuguggcgagcugagacccucuuacgaugccuucgucaaggugcgggacauuaaugacuuucaucacgcuaacgaugccuaucucaauaucguugugggaaacgucuacuaugaaaaauucaagaauuuuuacaucaacaaucgcauugacuaugauaacaauggcaagaaagaccuguccgugcucgcgagcaagcuguucacgaaaacccaagccgaugacaagacagggaacaucuacugggaggcuagauuucauaacgaaaaagagaccgauucuaauggaaaggagcggacaauuaagguuagagacgaaggcaccgaguccacguucgauaaaaucgaauauuacauggagcuuaacgacccgcuggugacacagaugcaguacacccucagcgggaagcagggauuuuucaaaaagauuacacugaaaaccaaggccaaagauaaugaagacaacucugauaagcuguuuccucuuaagcaauaucugcgcuccgacagcaauaaagucauggacgugaacaaguacggcggguauuccgauaugaucacccccuacuucaugcucgugcagagcgagggcaaaaagggaaaacacaucuauucucuggagagcauucccacaaucuaccucaaguccuucaagaaaaaggaagaggacauuaucaauuaucugucuugcaaaaacaaacuuaagaauccugucguuauuagcgauaagcugcugaugcggacgaucgugaagauuccguacuuuaaaaacgacuccaaucucucucuggugaaacuuggcaccagcgggagaacaggaaacaauaucaucuacauuaaccuguccgaacucauccugcccauugaguggaagaauuauuaccgcaagaucucuaaccuccugggcaccaacgucagcuccacaaaaccuaaggaucuuagcaaguucaccgaacagaugaaaaaugaccccacgucuacacugguggauggguccaacaagguugagcaugacaaaaauaaccgguuuuucagcuaucugauuaauaacgugaucaauaagccuaucuuugagggacuccccaaaaccucuugcuccuucauuaagcuggaaagcaaauacgaugaguuuuguucccuuaacacccuggaacaggcuaagaucauugccacaaucauuaagcuccugucuugcaaaagcguccaaggcuguaagcucuccaaucugagcgggcuuccuucuucccugggcgcccugaucagcaacaaagcucucaccgagggaacaaucauuucuaaggaaagcuccugcggccugaaagagaauaucauuuucgugguucccaacgacuga

SEQ ID NO: 4617 - RNA, 5067 nt, Artificial Sequence
  Cas9 variant
auggaguucaagaaagugcugggccucgacaucgggaccaacagcauuggaugcgcccugcuuucccugcccaagucuauccaggauuacggcaaagggggaagacucgaauggcugacaagccgggucauuccucuugacgcugauuauaugaaggccuuuaucgacggcaaaaaugggcugccgcaaguuauuacgcccgcgggaaagcgcagacagaagcggggcucccgcagacucaaacaccgguacaagcugcgcagaucucggcugauccgcguguucaaaacccucaacuggcugccugaggauuuuccccuugacaauccuaagagaaucaaagaaacaauuagcaccgagggcaaguucuccuuucggaucucugauuaugugcccauuagcgacgaauccuaccgcgaguucuauagagaguuuggguacccugaaaacgagaucgaacaggucauugaggagaucaauuuccggcgcaagacaaaaggaaagaacaaaaauccgaugauuaagcugcuccccgaagauugggugguuuauuaccugagaaaaaaggcucuuaucaaaccuaccacaaaggaggaacugauccggauuaucuaccucuuuaaccagagacgcggcuucaagagcucucggaaagaccugaccgagacggccauucuggauuaugacgaauuugccaagagacucgcugagaaagagaaguacuccgccgaaaauuaugagaccaaauucgugagcaucacaaaggucaaggaagugguugagcugaaaaccgaugggcgcaagggaaaaaagcgguuuaaagugauucuugaagacucuagaaucgagcccuacgagaucgaacgcaaggagaagccugacugggaaggcaaagaguauacauuccuggucacccaaaagcucgaaaaagggaaguucaaacagaacaagcccgaucugccgaaggaggaggacugggcucuuuguacgacagcccuggauaaucggaugggauccaaacauccuggcgaauuuuucuuugacgagcuccugaaggcguucaaagaaaagagaggcuacaaaauucgccaguaucccgugaaccgguggagauacaagaaagagcuggaguuuaucuggaccaagcagugccaacucaauccugaacugaacaaucuuaacauuaacaaggagauccugcgcaaacucgccacagugcuguaccccagccagucuaaguucuuugggcccaaaauuaaggaauucgagaauuccgauguccuucacaucaucagcgaagacauuaucuauuaccagcgggaucugaaaucccagaagucucucauuagcgaguguagauaugagaagcggaaaggaaucgacggcgaaauuuacgggcugaagugcaucccuaaauccagcccgcuguaucaagaguuucgcauuuggcaggauauccauaacaucaagguuauuagaaaagaaucugaggugaauggaaagaagaaaaucaacauugacgaaacccagcucuacaucaaugagaacauuaaggagaaacuguucgaacuuuuuaauuccaaggauagccugucugagaaagacauccucgaacugaucagccugaacauuaucaauuccggcauuaagaucucuaagaaagaggaagagaccacacaccggauuaaccuuuucgcuaauagaaaggagcucaaagggaacgaaacgaagagccgcuaucggaaaguguuuaagaaacugggauucgacggcgaguacauccugaaucaucccuccaagcucaacagacuguggcacagcgauuacucuaaugacuaugccgauaaggaaaaaaccgagaaguccauccuuagcucucugggcuggaaaaaccgcaacgggaagugggagaaauccaagaauuacgacgucuucaaccucccucuggaaguggcuaaggccauugcgaaucugcccccucuuaaaaaggaguauggaagcuacuccgcccucgcuaucagaaaaaugcugguugugaugcgggauggcaaguauuggcaacaccccgaccagauugccaaagaucaggaaaacacaucucugaugcucuuugacaagaaucugauccagcuuaccaacaaucaacgcaagguccugaacaaauaccuccugacacuggcugaggugcagaagagaagcacccuuauuaaacagaagcucaaugaaaucgagcauaacccguauaaacuggagcugguuuccgaucaggaccucgaaaagcaagugcugaagucuuuccuugagaaaaagaaugaaagcgauuaccugaaagggcucaagacguaccaggccggauaucugaucuacggcaaacacuccgagaaggacgucccuauugugaacagccccgaugaacugggggaguauauccggaagaaacuuccuaauaacucucuccgcaaucccauugucgagcaggugaucagagaaacaauuuuuaucguucgggacguguggaaguccuucggcauuaucgacgagauccauauugaacugggacgcgagcugaaaaacaacagcgaagagagaaagaaaaccucugagucccaggaaaagaauuuucaagagaaagaacgggcccgcaagcuccugaaggagcuucugaacagcucuaauuucgagcacuacgaugaaaacggcaauaaaaucuuuagcuccuucaccgucaacccuaaucccgacagcccgcucgauauugagaaguuuagaaucuggaaaaaccagucugggcugacagacgaagagcugaauaagaaacuuaaggaugaaaagauuccuaccgagaucgaggugaaaaaguauauccuguggcucacacagaaaugucggucccccuacacgggaaagauuaucccccugagcaaacucuucgacuccaacguuuaugaaauugagcacaucauuccuagaucuaagaugaagaaugauagcaccaacaaucuggugaucugcgaacuuggcgucaacaaagcuaagggggaccgccuggcggccaauuuuaucuccgagucuaacggaaaauguaaguucggcgaaguggaguacacacuccugaaauacggggauuaucugcaguacugcaaggacaccuuuaaguaucaaaaagcuaaguacaaaaaccuucuggccacagagccgcccgaagauuucauugagcggcagaucaaugacaccagauauauuggccgcaagcucgccgaacugcucacgccugugguuaaagauagcaagaacaucauuuucaccaucggauccauuacaucugagcugaaaaucaccuggggccuuaauggggucuggaaggacauccugcggcccagauuuaagcgccucgaaagcauuaucaacaaaaagcugauuuuccaggacgaggaugacccuaauaaauaccauuuugaucuguccaucaacccccaacuugacaaggagggacugaaacggcucgaucacagacaucacgcucuggacgccacaauuaucgcggcuaccacgcgcgaacaugugcgguaucucaauagccugaacgccgccgauaaugacgaggaaaagagagaguacuuccuuucucuguguaaccacaagauccgggauuuuaaacugccuugggagaauuucacauccgaagugaagagcaaacuccugucuugcgucguguccuacaaggagagcaaacccauucuuucugacccguuuaacaaguaucugaagugggaauacaaaaauggcaaguggcagaaaguuuucgcuauccagauuaagaacgaucgcuggaaagccgugagacgguccauguuuaaggagccuaucgggaccgucuggauuaagaaaaucaaggaagugagccucaaagaggcuaucaagauucaggccaucugggaggaaguuaaaaaugaccccgugcgcaagaaaaaggagaaguauauuuacgacgauuaugcgcaaaaagucaucgccaagauugugcaggaacugggacucuccagcucuaugagaaaacaggacgaugagaagcugaacaaauucaucaaugaagcuaagguuagcgccggcgugaacaagaaccuuaauacaaccaacaaaaccauuuacaaucuggaggggcgguuuuaugagaagaucaaagucgcugaauacgugcuguacaaggccaaaagaaugccucucaacaagaaggaguauaucgaaaaacugucccuucagaagauguucaaugaccugcccaacuucauucucgagaaaucuauccuggauaauuacccggaaauucucaaggagcuggagagcgacaacaaauauaucauugaaccucacaagaagaauaaccccgugaaucgccuucugcuggagcauauccucgaauaccacaacaauccuaaagaggcguuuuccacagagggccuggaaaagcuuaacaaaaaggccaucaauaaaauuggaaagcccaucaaguauauuacgcggcuggauggcgacaucaacgaggaagagauuuucagaggggcugucuuugaaaccgauaaaggaucuaacguuuacuucgugauguaugagaauaaccaaacaaaggaccgcgaguuucucaaacccaauccuagcaucuccgugcugaaggccaucgaacauaaaaacaagauugauuucuuugcuccgaaucggcucggcuucucuagaaucauucugagccccggggaccuugucuacgugccuaccaacgaucaguacguucugaucaaagacaauuccagcaacgagacaauuaucaauugggacgauaacgaauuuauuucuaaucgcaucuaucaggugaagaaguucaccggaaacuccuguuacuuucugaaaaaugacaucgccagccucauucugucuuauuccgccagcaacggcgucggggaguucggcucccagaauaucucugaauacagcguggaugaccccccuauucggaucaaggauguuugcauuaaaaucagaguggaccgccuuggaaacgucagaccccuguga

SEQ ID NO: 4618 - RNA, 3924 nt, Artificial Sequence
  Cpf1 variant
augacccaguucgagggcuuuacaaaccuguaccaagugagcaagacgcucagauucgaacugaucccccaggggaaaacccuuaagcacauucaggagcagggauuuaucgaagaggacaaagcccggaaugaucauuauaaggaacugaaaccuauuaucgaccgcauuuacaagacauaugcugaucaaugccuccagcugguccagcuugacugggagaaccuguccgccgcgaucgauucuuacagaaaggagaaaaccgaagagacacggaaugcucucaucgaggaacaggccaccuaucgcaacgccauucacgacuacuucaucggcagaacagauaaucugaccgacgcuauuaacaagcggcaugccgagaucuauaaagggcuguuuaaggcugaacucuucaauggaaaaguucugaagcaacuuggcacggugaccacaaccgagcacgaaaacgcccugcuccgcagcuuugauaaguucacaaccuacuuuuccggguucuacgagaauagaaagaacguguuuucugcggaagacauuagcacggccaucccgcaucggauuguccaggauaauuuccccaaguuuaaagagaacugucacaucuucacacgccugaucaccgcugugccuucccuuagagagcacuucgaaaauguuaagaaagccauuggaaucuuugugucuacaagcauugaggaagucuucuccuuucccuucuauaaccagcugcucacccagacccaaaucgaccuguacaaucagcugcucggcggcauuagccgggaggcugggacagaaaagaucaaaggacugaacgaggugcuuaaccuggccauccagaagaaugaugagacggcgcauauuaucgccucucucccucaccgcuuuauuccccuguucaagcaaauccuuuccgacagaaacacccugagcuuuauucucgaagaguucaaaucugacgaagagguuauccaguccuuuugcaaguauaaaacacugcugcggaaugaaaacgugcucgagaccgcugaggcccuguucaaugaacuuaacagcaucgaucugacacauauuuuuaucucucacaagaaacucgagaccauuuccagcgcucugugugaccacugggauacgcuucgcaaugcccuguacgaaagacggaucuccgagcucacaggcaagauuaccaagucugccaaagagaagguccagagaagccugaaacaugaagacaucaaccugcaggagauuaucuccgcugcggggaaggaacucagcgaggccuucaaacaaaagaccucugaaauccugucccacgcucaugccgcccuugaucagccucugccgacaacccucaagaaacaggaggagaaggaaauucugaaaagccagcuggacucucuucucggacuguaucaccuucucgauugguuugcuguggacgagagcaaugaaguggaucccgaguucuccgcccgccugacaggcaucaaacuugaaauggagccuucucugagcuucuacaacaaagcgcggaauuaugcuacgaagaagcccuacuccgucgagaaauuuaagcucaacuuccaaaugccuacccuggccagcgggugggacguuaauaaagaaaagaacaauggagccauucuguuugugaaaaacggccuuuacuaucucggcaucaugcccaagcagaaagggagauacaaggcucugucuuucgagccgacagaaaagaccuccgagggauuugauaaaauguauuacgacuauuucccugacgccgcuaagaugauucccaaaugcagcacacagcugaaggccgugaccgcgcauuuucagacgcacaccacaccuauccuccugucuaacaauuucaucgaaccccuugagauuaccaaagagaucuacgaucugaacaaucccgaaaaggagccuaagaaauuucaaacagccuaugcuaagaaaaccggcgaccagaagggguaccgcgaagcccucuguaaauggauugauuucacgcgggacuuucuguccaaguacacaaagaccacaagcaucgaucuguccucucuuagaccgagcucccaguauaaagaccucggagaguacuaugcugagcugaacccccugcucuaccacauuucuuuccagcgcaucgccgaaaaggagaucauggaugcggucgaaaccggcaaacuguaucuuuuucaaauuuacaauaaggacuucgccaaagggcaucacggaaagccuaaccugcauacccucuauuggacaggccuguucagccccgagaaucuggcuaagacguccaucaaacuuaacggccaggccgaacucuuuuaccggccuaagagcagaaugaaacgcauggcucaccggcugggggagaagaugcugaauaaaaagcucaaagaucagaagacccccauuccggacacacuguaccaagagcuuuaugauuacgugaaccacagacugucucaugaccucuccgaugaagcccgcgcccugcugccuaauguuaucaccaaggaggugagccacgaaauuaucaaagaccggagauucacaucugacaaguuuuucuuucauguccccaucacccuuaacuaucaggcugccaauuccccuagcaaauucaaccagcgggugaaugcguaccugaaggagcaccccgaaacgccuauuaucggaauugaucgcggcgagagaaaccucaucuauauuacaguuaucgacucuaccgggaaaauucuggagcagcggagccucaacaccauccaacaguuugauuaccagaagaagcuggacaauagagaaaaagagcgcguggcugcccggcaggccugguccgucgugggaacaaucaaggaucuuaaacaaggcuaucugagccaggucauucaugaaaucguggaccucaugauucacuaccaggcuguugugguccuggagaaccugaauuucggguuuaagucuaaaagaaccggcaucgccgaaaaggcgguguaccagcaauucgagaagaugcuuauugauaaacugaacugccucguucugaaggacuaucccgcugagaaagugggaggcguccucaauccguaccagcugacagaucaguuuacguccuucgccaagauggggacccaaagcggauuccuguuuuaugugccugcccccuacacauccaaaaucgacccccugaccggcuucguggauccuuuuguuuggaagacaaucaagaaccacgaaucucgcaaacauuuccucgagggguuugacuuccugcacuaugaugucaagaccggagacuuuauucugcauuucaaaaugaauagaaaccuuagcuuucagcggggccugccgggguucaugcccgcuugggacaucguguuugaaaagaaugagacgcaguucgaugccaaaggcaccccuuuuauugcgggaaagcgcaucgugcccgucauugagaaccacagauucacaggccgguaccgcgaccucuauccugcuaaugaacugaucgcccuccuggaggaaaaggggaucguguucagagauggauccaacauucuucccaaacugcuggagaaugacgauucucaugccaucgacaccaugguugcucucauucggagcgugcugcagaugcgcaacuccaaugccgcuacaggcgaagauuacaucaacucuccugucagagaccuuaacgggguguguuuugauagccgguuccaaaaucccgaguggccgauggacgccgaugcgaacggagccuaccacauugcucugaagggccagcuccugcucaaucaccugaaagaguccaaggaccuuaaacugcagaacgggaucagcaaucaggacuggcuggccuauauucaagaacuccgcaacuga

SEQ ID NO: 4619 - RNA, 3903 nt, Artificial Sequence
  Cpf1 variant
augagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccaaugauauuccuacaagcaucauuuaccggaucguggacgauaaccuuccgaaguuccuggagaauaaagcuaaguaugaaucucucaaagacaaggcccccgaggcuaucaacuacgaacagauuaaaaaggaucuggccgaggagcugaccuuugacaucgauuauaagacauccgaagucaaucagcgcguguucagccucgacgagguuuucgaaauugcgaacuuuaacaauuaccugaaccaguccggcaucaccaaauucaauacgauuaucgggggaaaguuugugaacggcgagaauaccaaaagaaagggcaucaacgaauauauuaaucuuuacucucaacagaucaacgauaaaacacugaagaaguauaaaaugagcguccucuucaagcagauucuguccgacaccgagagcaaaucuuuugugaucgacaaacuugaggaugacuccgauguugugacaaccaugcagagcuucuacgaacaaauugccgcuuuuaaaacggucgaggaaaagucuaucaaagagacacugagccuccuguucgacgaucugaaggcccagaagcucgaccuguccaaaauuuacuuuaagaaugauaaaucucuuaccgaccugagccagcaaguguucgaugacuauuccgugaucgggacagcuguccucgaauacaucacccagcagauugccccuaagaaccuggauaaucccagcaaaaaggagcaggagcuuaucgcgaagaaaaccgaaaaggccaaauaucugucucucgagacaauuaagcuggcucuggaagaguuuaacaaacaccgggacaucgauaagcaaugucgcuucgaggaaauucucgccaauuuugcugccaucccuaugaucuucgacgagauugcccagaacaaggacaaucuggcucagaucuccauuaaauaccagaaccaaggaaagaaagaucuucugcaggcgagcgccgaagacgauguuaaggcuaucaaagaccuccuggaucagacgaacaaucugcuucauaagcucaagauuuuccacaucucucaguccgaggacaaagccaacauccuggauaaggacgaacauuuuuaucugguguucgaggagugcuacuuugaacucgccaauauugugccccuguauaacaaaaucagaaauuacauuacccaaaagccuuacagcgaugagaaauucaaacuuaacuuugaaaauuccacacuggcuaacggcugggacaagaauaaggagccggauaacaccgccauccucuucauuaaggacgauaaauauuaccugggggucaugaauaagaaaaacaauaagaucuuugacgacaaagcgaucaaggaaaacaagggagagggcuauaaaaagauuguguacaaacugcuucccggggcuaauaagaugcucccuaaaguuuucuuuucugccaagagcaucaaguucuauaaccccuccgaggauauucugcggauccgcaaccacucuacacacaccaaaaauggaagcccucagaagggcuacgaaaaauuugaguucaacauugaagacuguagaaaguuuaucgauuucuauaaacaguccauuagcaagcaucccgaguggaaggacuucggcuuucgguucucugauacgcaacgcuacaauuccaucgacgaauuuuacagagagguggagaaccagggguauaaacugacauucgaaaauaucagcgagucuuacauugauuccgucgugaaccagggaaagcucuaucuguuucagaucuacaauaaagacuucagcgccuauucuaagggccggccgaaccuucacacccuguacuggaaagcucucuuugaugaacgcaaucugcaagacguuguguauaagcugaacggggaggccgagcuuuucuacagaaagcagagcauuccuaaaaagaucacccaucccgcuaaagaagccauugcgaauaagaacaaagauaauccuaagaaagaguccgucuuugaauacgaccucaucaaggacaagcgguucacagaggauaaauuuuucuuccacugccccaucaccauuaacuuuaagagcucuggagccaauaaauucaacgacgaaaucaaccugcugcucaaggagaaagcuaaugaugugcacauucuguccaucgacagaggcgagcgccaucuugccuauuacacacuggucgaugggaagggaaacauuaucaagcaggacacguuuaauaucauuggcaacgaucggaugaaaaccaauuaucacgacaagcucgcugccaucgaaaaagauagagacagcgcgcgcaaggauuggaaaaagauuaacaauaucaaggagaugaaagaaggcuaccugucccaggugguucaugagauugccaagcuggugaucgaauauaacgcuauugucguguucgaggaccuuaauuuuggguucaaacggggaagauuuaagguugagaaacaaguguaccagaagcucgaaaagaugcugaucgagaaacugaacuaucucgucuucaaggauaaugaauuugacaaaacaggcggggugcugcgcgccuaccagcuuaccgcucccuucgagacauuuaagaaaaugggaaagcagaccggcaucauuuacuaugugccugccggguucacgucuaaaaucuguccgguuaccggcuuugucaaccaacuguaccccaaguaugaaagcguguccaagucucaggaguucuucagcaaauuugacaagauuugcuacaaucucgauaaaggauauuucgaguuuuccuucgacuacaagaacuuuggcgauaaagccgcuaaggggaaguggacaaucgcgucuuucggaagccggcugauuaauuuuagaaacuccgacaaaaaucacaacugggauacccgcgaaguguauccuacaaaggagcuggaaaaacuucugaaggacuacagcaucgaguacggccauggggaguguaucaaagccgcuauuugcggagaaucugauaagaaguucuuugccaaacucaccuccguccugaacacgauccuccagaugcggaauagcaagacaggcaccgagcuggacuaucuuauuucucccguggccgauguuaacgggaauuucuuugacuccagacaagcuccuaaaaacaugccccaggaugccgacgcgaauggcgcuuaccacaucggacugaagggccucaugcugcuggggcgcauuaaaaacaaucaggaaggaaagaaacuuaaccuggugaucaagaaugaggaauauuucgaguuuguccagaaccggaauaacuga

SEQ ID NO: 4620 - RNA, 1341 nt, Artificial Sequence
  Cpf1 variant
augaagcccgacaucaaagauagagaguacauguaucggcugauuaucggccaacucuucuacgacgggcaccagcagauugccgugaaccuggcuaauacccuuggaugcagcgccccuccgcccccucccuccgauaagcuguuucgccucgucacaaucgcgaaacaguucguugaagacccugauuauaaggcugaggaaaacacgaugcccaugcaguuugagaccucuagcgccggccuggaccuucaauacgaugccgacguggcugccacauccccugaaccgucucaguaugagaccauuuaccugacagugcauaaagcucccuguagagccgcggccuucaauagcgaugggucccucaucgcuaccggaucugccgacugcagcaucaagauuauggaugucgagcggauccuggcucgcgaaaaggagcacagagaaaugaacgagaauggcccugacgcccaucaccccgugauucggacacuguaugaucauguugacgugcgcagagacuuugggcgguucuccgauaaaauccucgacuuucaggaugucaacaccgugauuuuccacccucgcgacgcgauccugauuagcggaucuaaugauaagacgguuaaacuuuuugacuucuccaagaccgccgugaaaagagcuaugaagacacugagcgaggucuaccccgugcgggcccucucuugucacccgggcggcgaauuucugcuuguggcuaccgaucauccuacaguccgccuguacaacaucgagaccgcccaggccuaugcuuccgcgaaucccgacgaucaacacagagaaagcguuacggacgugcauuacucugagaacgcccggcucuaugugacagcuuccaaggauggggacgucaaagugugggacggaguuagcucccgcugcguggaaaccuucaagagagcccacgauggcucuagcaucuguuccgccaaauuuacaaagaaugggaaauacauucugaccagcggaauggacucuaucgucaagcugugggagcucuccaccaaccggugccugauuguguauacaggcgcuggggccacgggagcgcaggauuacccuaccagcgcuucuuucaaucagaacgaggacuucguucuuuuucccgaugagaaaagcggcuccauguguucuugggaagccagaaaugccgaccgcaagcggcugcucgcucugggccacacaagcgccugcagaaccuucgugcauucccccagcaugccugcuuuuaugacagggucugaugaccaccgcgcccgguucugguauagaaagccgaccacgaacgauaacuga

SEQ ID NO: 4621 - RNA, 1293 nt, Artificial Sequence
  Cpf1 variant
augaagcccgacaucaaagauagagaguacauguaucggcugauuaucggccaacucuucuacgacgggcaccagcagauugccgugacccuggcuaacacacuuggaugcagcgccccugcgccgcccccuuccgauaagcuguaucgccucgucacgaucgcuaaacaguuuguugaagaccccgauuacaaggccgaggaaaaaucucugccuaugcaguucgagaccgugagcacaggccuugaccuggaauaugaugccgacgugcaacccgucuccccugagccgucucaguacgagaccauuuaucucacagugcauaaggcucccuguagagccgcugccuuuaauagcgaugggucccugguugcgaccggaucugccgacugcagcaucaagaucauggauguggaacggauucuggcucgcgagaaagaacacagagagaugaacgagaauggcccugacgcccaucaccccgucauccggacacucuacgaucauguggacgacguuaacaccgugcuguuccacccucgcgaugcuauucuuaucuccgggagcaaugacaagacggucaaacuguuugauuucucuaagaccgccgugaaaagagcgaugaagacacucuccgaaguguaccccguccgggcccugagcugucacccgggaggcgaguuucuucugguugcuaccgaccauccuacagugcgccucuauaacauugaaaccgcccaggcuuacgccucugccaaucccgaugaccagcacagagaguccgugacggauguccauuauagcgaaaacgcucggcuguacgugacagcgucuaaggacggcgauguuaaaaucugggacgggguguccaaucgcugcgucgagaccuucaagagagcccacgauggaagcgcuauuuguuccgccaaauuuacaaagaacggcaaauaucugcucaccucugggauggacagcaucgugaagcugugggagcuuuccaccaaucggugccugaucguuuacacaggagccggcgcuacgggggcccaagacuaugcgaccagcgcuucuuucaaccacaaugaagauuacgugcucuuuccugacgagaaauccggaagcauguguucuugggaugcccgcaacagcgacagaaagcggcugcuugcccugggccauacauccgcuugcagaaccuucguccacucucccagcaugcccgccuuuaugacaggcuccgaugaccaucgcgcucgguucugguacagaaagccugccaccacggauaauuga

SEQ ID NO: 4622 - RNA, 3690 nt, Artificial Sequence
  Cpf1 variant
auggccgcuagcaagcuggagaaauucaccaacugcuacucccucucuaagacacugagauuuaaagccauccccgugggcaagacgcaggaaaauauugacaacaaacggcuucuggucgaggaugaaaagcgcgcggaggacuauaaggggguuaaaaagcuccuggauagauacuaucuuagcuucaucaaugacgugcugcacuccauuaaacucaagaaccugaauaacuacaucucucuguuucggaaaaagacccgcacagaaaaggagaauaaagagcucgaaaaccuggagauuaaucuuagaaaggaaaucgcuaaagccuucaagggagccgcuggcuauaaaagccuguuuaagaaagauaucauugagaccauccucccugaggccgcugacgauaaggacgaaauugcccuggugaacuccuucaauggguuuacaaccgcguucacaggauuuuucgauaaccgggagaauauguuuucugaagaggccaagagcaccuccaucgcuuuccgcuguauuaacgaaaaucuuacgagauacaucagcaacauggacauuuuugagaaagucgaugccaucuucgacaagcaugaggugcaagaaaucaaagagaagauucugaacucugauuaugacguugaagacuucuuugagggcgaguucuuuaauuucgugcucacccaggaagggaucgaugucuacaacgcuauuaucggaggcuuugugacagaguccggcgaaaagauuaaggggcugaaugaguacaucaaccuguauaaugccaagaccaaacaggcgcucccgaaguucaaaccccuguacaagcagguucuuagcgaccgggaaucucuguccuuuuauggagagggcuacacaagcgaugaagaggugcucgaggucuuccgcaacacccugaauaaaaacucugaaaucuuuuccagcauuaagaaacuugagaaacuguucaagaauuuugacgaauauuccucugccgggaucuucgugaaaaacggaccugcuauuagcacgaucuccaaggauauuuuuggcgaguggaaucucaucagagacaaauggaacgccgaguacgaugacauccaccugaagaagaaagcuguggucacagaaaaguaugaggaugaccggcgcaagagcuucaagaaaauugggucuuucucccuggaacaacuccaggaguacgccgaugccgaccugagcguuguggaaaaacuuaaagagaucauuauccagaagguggacgagauuuacaaggucuauggaucuagcgaaaaacuguuugaugcugacuucgugcucgagaagucccugaaaaagaaugaugcgguuguggccaucaugaaagaccuucuggauucugucaagagcuuugaaaacuacauuaaggcuuucuuuggcgagggcaaagaaaccaauagagacgaguccuucuauggggauuuugugcucgccuacgacauccugcugaagguugaucauaucuaugacgccauucggaacuacgugacacagaaacccuauagcaaggauaaauucaagcucuacuuucaaaacccucaguucaugggaggcugggacaaggauaaagagaccgacuaccgcgcuaccauccugagauaugggucuaaguacuaucuugccauuauggacaaaaaguacgcgaaaugccugcagaagaucgauaaggacgaugucaauggaaacuaugaaaagauuaauuacaagcuccugcccggcccuaacaaaaugcugccgaagguguuuuucuccaaaaaguggauggcuuauuacaaucccagcgaggacauccagaaaaucuacaagaacgggacauuuaagaaaggagauauguucaaucuuaacgacugucacaagcucauugauuucuuuaaagacucuaucucccgguauccuaaguggagcaaugccuacgauuucaacuuuuccgaaacggagaaauauaaggacauugccggcuucuacagagaagucgaggagcaaggcuauaaggugucuuuugaaagcgcuuccaaaaaggagguugauaaacugguggaagaggggaagcuguacauguuccagaucuauaauaaagacuuuucugauaagagccauggaacccccaaccuccacacaauguacuucaagcugcuuuuugacgagaauaaccacggccagauucgccuguccgggggagccgaacucuucaugcggagagcuagccugaaaaaggaggaacuggucgugcauccugccaauucucccaucgcgaacaaaaacccggacaauccuaagaaaaccacaacccuuuccuacgauguuuauaaggacaagcgcuuuagcgaggaucaauacgaacuccacauccccauugccaucaacaaaugcccuaagaauauuuucaaaaucaacacggaggugcggguccugcugaagcaugacgauaaucccuaugugauuggcaucgacagaggggagcgcaaccuccuguacaucgugguugucgauggcaaaggaaauauuguggaacaguauucucuuaacgagaucauuaauaacuucaauggcauccggauuaagacagacuaccacucccugcucgauaagaaagaaaaggagagauuugaagcucgccagaacuggaccagcaucgagaauauuaaagagcugaaggccggguauaucucucaggugguccacaaaaucugugaacugguggagaaguacgacgcuguuauugcccuugaagaucucaacagcggauucaaaaauucccgggugaaggucgagaagcaaguguaccagaaauuugaaaagaugcugaucgacaaacugaacuauaugguugacaagaaaagcaaccccugcgcgaccggcggggcccucaagggauaccagauuacaaauaaguucgagucuuuuaaauccaugagcacccagaacggcuucaucuuuuauauuccugcuuggcugacauccaagaucgauccgucuacgggguucgugaaucuucugaaaaccaaguacacaagcaucgccgacuccaaaaaguuuauuucuagcuucgauagaaucauguauguccccgaggaagaccucuuugaguucgcucuggauuacaagaacuuuucccgcaccgacgccgauuauauuaaaaaguggaaacuguacucuuacggcaaucggaucagaauuuucgccgcugcgaagaaaaacaauguguucgccugggaagagguuugucuuacaagcgcuuauaaggagcucuuuaacaaguacggaaucaauuaucaacagggcgacauccgggcccugcugugcgaacaguccgauaaagccuucuacagcucuuuuauggcucucaugucccugaugcuucagaugcgcaacagcauuaccgggagaacggacguggauuuccugaucucuccugucaaaaauuccgacggaaucuuuuaugauagccggaacuacgaggcccaagaaaaugcgauucuccccaaaaacgcugacgccaauggcgccuauaacauugcuagaaaggugcugugggccaucgggcaguucaaaaaggcggaggacgaaaaacuggauaaggugaagauugcuaucucuaauaaagaguggcuugaguacgcccagaccuccgucaaguga

SEQ ID NO: 4623 - RNA, 3903 nt, Artificial Sequence
  Cpf1 variant
augagcaucuaccaggaguucgugaacaaguauucccugucuaaaacccucagauuugaacugauuccccaaggcaagacacuugagaauaucaaagcccgggggcugauucucgacgaugaaaagcgcgcuaaagacuacaagaaggccaaacagaucauugauaaguaucaccaguucuuuaucgaggaaauccugagcuccgucugcauuucugaggaccuucugcagaacuacagcgauguuuauuucaaacucaagaaauccgacgaugacaaucugcaaaaggauuuuaagucugcgaaagacacgaucaagaaacagauuagcgaguacaucaaggauuccgaaaaauucaagaaccuguuuaaucagaaccucauugacgcuaaaaagggacaggagagcgaucugauccuuuggcugaagcaaucuaaagacaauggcauugaacucuucaaggccaacuccgacaucaccgauaucgacgaggcccuggagauuaucaagagcuuuaagggguggacaaccuauuucaaaggauuucaugaaaauagaaagaacguguacucuuccgaugacauuccuacaagcaucauuuaccggaucguggaugacaaucuuccgaaguuccuggagaacaaagcuaaguaugaaucucucaaagauaaggcccccgaggcuaucaauuacgaacagauuaaaaaggaccuggccgaggagcugaccuuugauaucgacuauaagacauccgaagucaaccagcgcguguucagccucgaugagguuuucgaaauugcgaauuuuaacaacuaccugaaucaguccggcaucaccaaauucaacacgauuaucgggggaaaguuugugaauggcgagaacaccaaaagaaagggcaucaaugaauauauuaaccuuuacucucaacagaucaaugacaaaacacugaagaaguauaaaaugagcguccucuucaagcagauucuguccgacaccgagagcaaaucuuuugugaucgauaaacuugaggacgauuccgacguugugacaaccaugcagagcuucuacgaacaaauugccgcuuuuaaaacggucgaggaaaagucuaucaaagagacacugagccuccuguucgaugaccugaaggcccagaagcucgaucuguccaaaauuuacuuuaagaacgacaaaucucuuaccgaucugagccagcaaguguucgacgauuauuccgugaucgggacagcuguccucgaauacaucacccagcagguugccccuaagaaucuggacaaccccagcaaaaaggagcaggaucuuauugcgaagaaaaccgagaaggccaaauaucugucucucgaaacaaucaagcuggcucuggaggaauuuaauaaacaccgggacauugacaagcaaugucgcuucgaggagauccucgccaacuuugcugccauuccuaugaucuucgaugaaaucgcccagaauaaggacaaccuggcucagauuucccuuaaauaccagaaucaaggaaagaaagaucugcuccaggcgagcgccgaggaagacgugaaggcuaucaaagaucugcuggaccagacgaacaaccuucuccauagacugaagauuuuccacaucucucaguccgaggauaaggccaauauucuggacaaagaugaacauuuuuaucucguguucgaggagugcuacuuugaacuggccaacaucgucccccuuuauaauaagauccggaacuacauuacccaaaaaccuuacagcgacgagaaguucaaacugaauuuugaaaacuccacacucgcuaauggcugggauaagaacaaagagccggacaauaccgccauccuguucauuaaggaugacaaguauuaccugggggugaugaacaaaaagaauaacaaaaucuuugacgauaaggcgauuaaagaaaauaagggagagggcuauaagaaaaucguuuacaaacuucuccccggggcuaacaagaugcugccuaagguguucuuuucugccaaaagcaucaaguucuauaaucccuccgaggacauucugcgcaucagaaaccacucuacacacaccaagaacggaaauccucagaaaggcuacgaaaaguuugaguucaacauugaagauugucggaaauuuaucgacuucuauaaggagagcauuuccaaacaucccgaauggaaggauuucggcuuucgcuucagcgacacgcagagauacaauucuaucgaugaguuuuaccgggaggucgaaaaccaaggguauaagcucacauucgagaauauuuccgaaagcuacaucgacucugugguuaaccagggaaaacuguaucuuuuucagaucuacaauaaggauuucuccgccuauagcaaaggccgcccgaaccugcacacccucuacuggaaggcucuguuugacgagagaaaucugcaggauguggucuauaaacuuaacggggaggccgaacucuucuaccggaagcaaucuauuccuaagaaaaucacccaucccgcuaaggaggccauugcgaauaaaaacaaggacaauccuaaaaaggaaagcguguuugaguacgaccugaucaaagauaagagauucacagaagacaaguuuuucuuccacugccccauuaccaucaacuuuaaauccagcggagccaauaaguucaacgaugagaucaaccugcuccugaaagagaaggcuaaugacguccacauucuuucuaucgaucgcggcgaacggcaucuggccuauuacacacucguggacgggaaaggaaacauuaucaagcaggauacguuuaauauuaucggcaacgacagaaugaagaccaauuaucacgauaaacuggcugccaucgagaaggaccgcgauuccgcgcggaaagacuggaagaaaauuaacaauaucaaggaaaugaaggagggcuaccugagccagguugugcaugaaauugccaaacuugucaucgagcacaacgcuauugugguuuucgaggaucucaauuuuggguucaagagaggacgcuuuaaaguggaaaagcaggucuaucaaaaacuggagaagaugcugaucgaaaagcucaacuaccugguguucaaagacaaugaguuugacaagacaggcggggugcuucgggccuaucagcugaccgcucccuucgaaacauuuaaaaagaugggaaaacagaccggcauuaucuacuacguuccugccggguucacguccaagaucuguccggucaccggcuuugugaaccagcucuaucccaaauacgagucugugagcaagucccaagaguucuucucuaaguuugauaaaauuugcuauaaucuggacaagggauacuucgaauuuagcuucgauuauaaaaacuuuggcgacaaggccgcuaaagggaaguggacaaucgcguccuucggaucuagacugauuaauuuucgcaacagcgauaagaaucauaacugggacacccgggaggucuacccuacaaaagaacuugagaagcugcucaaagauuauuccaucgaguacggccacggggaauguauuaaggccgcuaucugcggagagagcgacaaaaaguucuuugccaagcugaccucugugcucaacacgauccugcagaugagaaauuccaaaacaggcaccgaacuugauuaccugauuagccccguugccgacgugaacgggaauuucuuugauucucgccaggcuccuaagaacaugccccaagacgccgaugcgaauggcgcuuaucacaucggacucaaaggccugaugcugcuugaccggauuaagaacaaucaggaggggaaaaagcugaaccucgucaucaagaaugaagaguacuucgaguuugugcagaacagaaauaacuga

SEQ ID NO: 4624 - RNA, 1071 nt, Artificial Sequence
  Cpf1 variant
augaagaccaacuaccacgacaaacuggccgcuaucgagaaggauagagaaagcgcccggaaagacuggaagaaaauuaauaacaucaaggagaugaaggaaggcuaucucucccaggugguccaugagauugcgaaacugguuaucggguacaaugcuauugugguguucgaagaucuuaacuuuggauucaagcgcggcagauuuaaagucgagaagcaaguguaucagaaacuggagaagaugcucaucgaaaagcugaauuaccuuguuuucaaagacaacgaguuugauaaggccgggggagugcugcgggccuaucagcucacagcucccuucgaaacguuuaaaaagaugggcaaacagaccgggaucauuuacuaugucccugccgacuucacaucuaagaucugcccggugaccggauuuguuaaucaacuguaccccaaauacgagagcguguccaagucucaggaguucuuuagcaaguucgauaaaauuuguuauaaccuggacaagggcuacuuugaguucuccuucgauuauaaaaauuuuggcgacaaggcugccaaagggaaguggacaaucgcgucuuucggaagccgccucauuaacuuuagaaauuccgauaagaaccacaauugggacacccgggaagucuacccuacaaaagaacuggagaaacuucugaaggauuauagcaucgaauacggccauggggagugcauuaaggccgcuaucuaugccgagaacgacaaaaaguucuuugcuaagcucaccucuauccuuaauuccauucuucagaugcgcaacagcaaaacgggaaccgaacuggacuaccucaucucucccguggccgaugugaacggcaauuucuuugacuccagacacgcgccuaagaacaugccccaggaugccgacgcuaauggggccuaccauauuggacugaaaggccugaugcuccuguaucggaucaagaacaaucaagauggcaaaaagcugaaccuggucauuaagaaugaggaauacuucgaguuuguucagaaccgcaauaaaagcucuaagaucuga

SEQ ID NO: 4625 - RNA, 3792 nt, Artificial Sequence
  Cpf1 variant
auggaggacuacagcggcuucgugaacaucuauuccauucagaagacccugagauuugaacucaaacccgucgggaagacacuggagcacaucgagaaaaagggauuccuuaaaaaggauaagauucgggccgaggacuacaaagcuguuaagaaaaucauugauaaguaucaucgcgccuacaucgaagagguguuugacucugugcugcaccagaaaaagaagaaagauaagacgagauucagcacccaauuuaucaaagagauuaaggaguucuccgagcucuauuacaaaacagaaaagaauaucccugacaaagagcggcuggaggcgcuuucugaaaagcugcgcaagaugcucgucggcgcuuuuaaaggggaguucagcgaagagguggccgaaaaguauaaaaaccuguuuuccaaggagcugauuagaaaugagaucgaaaaauucugcgagaccgaugaggaacggaagcagguuucuaacuuuaagagcuucacaaccuacuuuacaggauuccauuccaaucgccagaacauuuacagcgacgagaaaaagucuaccgccaucggcuauagaauuauccaccaaaaucucccgaaauuccuggauaaccuuaagaucauugaauccauccagcggcgcuuuaaagacuuccccuggagcgaucugaagaagaaucucaaaaagauugacaaaaacaucaagcugacggaguacuuuucuauugauggguucgugaauguccuuaaccagaaaggaaucgacgcuuauaauaccauccugggcggcaaguccgaagagagcggggaaaagauucagggacucaacgaguacaucaaucuguauagacagaaaaacaacauugaccggaagaaucugccuaacgugaaaauccucuuuaagcaaauucugggcgaucgcgaaacaaaaucuuucauccccgaggccuuuccugacgaucaguccguucuuaauagcaucaccgaguucgcuaaguaccugaaacucgacaagaagaaaaaguccauuaucgccgaacugaaaaaguuucuuucuagcuucaacagauaugagcuggaugggauuuaccucgcgaaugacaacucccuggccagcaucucuacauuucuguucgaugacugguccuuuauuaaaaagagcgugucuuucaaguacgaugaaagcgucggagaccccaaaaagaaaaucaaguccccucucaaauaugagaaggagaaggaaaaauggcugaagcagaaauacuauaccauuucuuuccuuaaugaugcuaucgagagcuacuccaagagccaagacgaaaaacgggugaagauccgccuggaggccuauuuugcugaguucaagucuaaagacgaugccaagaaacaguuugaccuccuggaaagaauugaggaagcguacgccaucguggagccgcuucugggcgcugaauauccccgggauagaaaccucaaggccgacaaaaaggaggucgggaaaauuaaggauuuccuggacuccaucaagagccugcaguuuuuccucaaaccucugcuuucugcugaaauuuuugaugagaaggaccugggauucuacaaucaacucgagggcuacuaugaagagaucgauuccaucggccaucuguacaacaaaguucgcaauuaucugacggggaagauuuacagcaaagaaaaguuuaaacuuaacuucgaaaauuccacacuccugaaaggaugggacgaaaaccgggagguggccaaucugugugugaucuuuagagaggaucagaaguauuaccucggcgucauggacaaagaaaacaacaccauucugucugauauccccaaggugaaaccuaaugagcuuuucuaugaaaagaugguuuacaagcugauucccacaccgcacaugcagcucccucgcaucaucuuuagcuccgacaaccugucuauuuacaaucccagcaaauccauccugaagauucgggaggccaagagcuucaaggaggggaaaaacuucaaacuuaaggacugccacaaauuuaucgauuucuauaaggaaucuauuuccaaaaaugaggacuggagcagauuugauuucaaguuuucuaaaaccuccagcuacgaaaacaucucugaguucuaucgcgaaguggagcggcagggauacaaucucgacuuuaagaaggucagcaaauucuauaucgauucccugguggaggacggcaagcuguaccucuuucaaauuuauaacaaagauuucagcaucuuuucuaaggggaaaccuaaucugcauaccauuuacuucagaucccuuuucagcaaggaaaaccugaaagacguuugucucaagcugaauggagaggcugaaauguuuuuccgcaagaaauccaucaacuacgaugagaagaaaaagcgggaaggccaccaucccgagcuguuugagaaacuuaaguaucccauucucaaggacaaaagauacucugaagauaaguuccaguuucaucugccuaucagccugaauuucaaauccaaggagcgccucaacuuuaaucugaaagugaacgaguuccuuaagcggaacaaggacauuaauaucaucggcauugauagaggggaacggaaccugcucuaucuggucaugaucaaucagaaaggagaaauucugaagcagacacuucucgacucuaugcaaagcggcaaagggcgcccggagaucaacuacaaggagaaacugcaggaaaaggagauugaaagagacaaggcgcggaaauccuggggaacgguggagaauaucaaggagcugaaagaaggcuaucucucuaucgucauucaccagaucagcaagcugaugguggagaacaaugccauuguugugcuugaagaucugaacaucggguuuaaaagaggccgccagaaggucgagcggcaaguguaccagaaauucgaaaagaugcucauugacaagcugaauuuucugguuuucaaagagaacaagcccaccgagccuggaggcgugcuuaaggcuuaucagcugacagaugaauuucaguccuucgagaagcucagcaaacaaaccggguuccuguuuuacguccccucuuggaauacauccaagaucgacccuagaaccggauucaucgauuuucuccaccccgccuacgaaaacauugagaaggccaaacaguggaucaauaaguucgacagcauucgcuuuaacucuaaaauggauugguucgaauuuacggcugacacaagaaaguucuccgagaaucugaugcuuggcaaaaaccgggugugggugaucugcaccaccaacguugagcgcuauuuuacaagcaagaccgccaauucuuccauucaguacaacagcauccaaauuacagaaaagcugaaagaacucuucgucgauaucccguuuuccaaugggcaggaccugaagccugaaauccugcggaaaaacgaugcgguguucuuuaagagccuucuguucuauauuaaaacgacccucucucugagacagaauaacggaaagaagggcgaggaagagaaagacuucauccucagccccguggucgacuccaaggggcgcuuuuucaauucucuggaggcuagcgaugacgaaccuaaagaugccgacgccaacggcgcuuaccacauugcccuuaagggacugaugaaucuccuggugcugaacgagacaaaagaagagaaucuuuccagacccaaguggaaaaucaagaacaaggauuggcuggaguuuguuugggaacggaaucgcuga

SEQ ID NO: 4626 - RNA, 2820 nt, Artificial Sequence
  Cpf1 variant
augaaccuguacagcaaucucaccaacaaguauucccugucuaaaacacuuagauucgagcugaucccccagggcgaaacgcucgagaauauuaaggcccgggggcugauccuugacgaugaaaaacgcgcuaaggacuacaaaaaggccaagcaaauuaucgauaaauaucaccaguuuuucauugaggaaauccugagcuccgugugcaucucugaggaccuccugcagaacuacagcgaugucuauuuuaagcugaaaaaguccgacgaugacaaucuccagaaagauuucaagucugcgaaggacaccauuaaaaagcauaucagcagauacauuaacgauuccgagaaauuuaagaaucuguucaaccaaaaucuuaucgacgcuaaaaagggacaggaaagcgaucugauucucuggcugaaacagucuaaggacaacggcaucgagcuuuuuaaggccaauuccgacauuacagauaucgacgaagcccuggagaucauuaagagcuucaagggguggaccacauauuuuaaaggauuccacgagaaccggaagaauguuuacucuuccgaugacaucccuaccagcauuaucuaccgcauuguggaugacaaccucccgaaauuuaucgaaaauaaggcuaaguaugagaaccugaaagauaaggcccccgaagcuaucaacuacgagcagauuaaaaaggaccuggccgaggagcucacauucgauaucgacuauaaaaccucugaggugaaucaaagagucuuuucccuggaugaaguguucgagauugcgaacuucaauaacuaccuuaaucagagcggcaucacgaaguuuaacaccauuaucgggggaaaguucguuaauggcgaaaacacaaaacggaagggcaucaaugaguauauuaaccuguacucccagcagaucaaugacaaaacccucaagaaauauaagaugucugugcuguuuaagcaaauucuuagcgacacagaauccaagagcuucgucaucgauaaacuggaggacgauucugacgugguuaccacgaugcaguccuuuuacgagcagauugccgcuuucaaaacacucgaagaaaagagcaucaaagaaacccugucucugcucuuugaugaccugaaggcccaaaaacuugaucugagcaagauuuacuucaagaacgacaaaucccucacagaucugucucagcaggucuuugacgauuauagcgugaucgggaccgcugugcuugaguacaucacccagcaaguggccccuaagaaucuggacaaccccuccaaaaaggaacaggaucucauugcgaaaaagacagagaaggccaaauaucugagccuggagacgaucaagcucgcucuggaagaguucaauaaauaccgcgacauugacaagcaguguagauuugaagagaucuucgccucuuuugcugauauuccuguccuuuucgacgagaucgcccagaacaaaaacaaucuggcccaaaucuccauuaaguaucagaaccagggaaagaaagaucuccugcagaccagcgcugaaguugacgugaaggcgaucaaagaucugcuugaccaaacaaauaaccuccugcauaagcugaaaauuuuccacaucacccagucugaggauaaggccaauauucucgacaaggaugaacauuuuuaccugguguucgacgagugcuauuuugaacuugcuaacaucgucgcccuguacaauaaaauccggaacuacauuacacagaagcccuauuccgaugagaaauucaagcucaauuuugagaacagcacccuggccaauggcugggacaaaaacaaggaaccugauaauacggcuauccuguucauuaaagacgacaaguacuaucuuggggugaugaacaagaaaaauaacaagaucuuugaugacaaagccauuaaggagaacaaaggagaaggcuacaagaagguuguguauaaacuccugccgggggcgaauaagaugcugcccaaagucuucuuuuccgcuaagucuaucaacuucuacaauccuagcgaggauauccuccgcauuagaaaccacuccacacacaccaaaaauggaucuccccagaagggcuaugaaaagcuggaguuuaacaucgaggacugucggaaauucauugauuuuuacaagcauagcaucucccgccacccugaauggaaagacuucggcuucagauuuagcgauaccaagaaauacaauucuauugacgaguucuaucgggaaguggagaaccaaggguacaaacuuacauuugaaaauaucuccgagagcuauauugauucucugguugacgagggaaagcucuaccuguuccagaucuauaacaaagauuuuuccguguacagcaagggcaaacccaaucugcauacccuuuauuggaaggcccucuucgacgaacgcaaccugcaggacgucguguacaaacugaauggggaggccgaacucuuuuacagaaagcaaucuaucccgaagaaaauuacacacccugcuaaggaggccaucgcuaacaaaaauaaggauaaccccaaaaaggagagcauuuucgaauaugaccugaucaaagauaagcgguuuacggaggacaaguucuuuuuccacugcccuauuaccaucaacuucaaauccagcggagccaauaaguuuaacgaugaaaucaaucuucugcucaaagagaaggcgaacgacguccauauucugucuaucgauagaggcgaacgccaccuggccuacuauacacuuguggacgggaaaggaaauauuaucuguaagaacuga

SEQ ID NO: 4627 - RNA, 3795 nt, Artificial Sequence
  Cpf1 variant
augcuguuccaggaguuuacccaccucuacccccugagcaagacagugagauucgaacuuaaaccuaucggcaagacgcuggagcauauucacgccaaagacuuucucucccaagaugaaaccauggcugacauguaucagaaggucaaagccauccuggaugacuaccaucgggauuucauugcggacaugaugucugggguugugcuuacaaagcuggcugaguuuuaugaaguguaccucgcccugcgcaagaccccgaaagaugacagccugcagaagcagcucacagagauccaaaccgcccugagaaaagagauugucaagcccaucggauccggcgggaaauauaaggcuggauacgaucggcuuuucggcgccaagcuguuuaaagacgggaaggaacucggagaucuggcuaaauucgugaucacacaggagggcgaaucuagcccuaaacuugcccacauugcgcauuuugagaaauucuccaccuauuuuacgggcuuccacgacaaccgcaagaauauguacucugaugaggacaaacacaccgccaucgcuuacagacugauucaugaaaaccucccccgguuuaucgacaaucugcagauucuggccacaaucaagcagaagcacagcgcucucuaugaucaaauuguuaacgagcugaaugccaacgggcuugacgugucccuggcgagccaucucgauggauaccacaaacugcuuacccaggaaggcaucacagccuauaauacccugcucgggggaaucucuggcgaggcugggucccgcaagauucagggaaucaacgaacugauuaauauccaccauaaccagcacugccagaaaagcgagagaauugccaagcugcggccucuccauaaacaaauccugucugacggcaugggcgucuccuuccuucccagcaaguucgcugaugacucugaggugugucaggccguuaaugaauuuuaccgccacuaugcccauguguucgcuaagguccaaucccuguuugauagauucgacgauuaccggaaagacgggaucuauguggagcacaagaaccucaaugaacugagcaaacaggcguuuggagauuucgcccuucugggccgcgugcucgacggguacuacgucgacguugugaacccugaguuuaaugaaagauucgcuaaggccaaaacggauaacgccaaggagaagcugacaaaagagaaggacaaauuuauuaagggagugcacucccuggcuucucucgaacaggccaucgagcauuauauugcgggccacgaugacgaaagcguccaggcugggaaacugggacaauacuucaagcauggccuugccggcguggauaacccgauccagaagauucacaauucccacagcaccaucaaaggguuucuggagcgggaacgccccgccggagagagagcucucccuaagaucaaaucugacaagucccccgagaugacacagcugcggcagcugaaagaacuucucgauaacgcccugaauguugugcauuucgcuaagcugcucaccaccaaaacaacgcuggacaaccaagauggcaauuuuuauggggaguucggagcccuuuacgacgaacuggcgaagauugccacccucuauaacaaggucagagauuaccugagccagaaaccuuucucuacagagaaguauaaacugaauuuuggcaaccccacccuucucaaugggugggaccugaacaaggagaaagauaauuucggcgugauccugcagaaggacggaugcuacuaccucgcucugcuugacaaggcccacaaaaagguuuuugauaacgcuccgaaugccggcaaaagcguguaucagaagauggucuacaaacugcucccugggcccaacaagaugcugccuaagguguucuuugcgaaauccaaucuggacuauuacaaccccucugccgaacuucucgauaaguaugcucaaggaacacauaaaaagggcaacaauuucaaccugaaagacugucacgcccugauugauuucuucaaggcuagcaucaauaagcaucccgaguggcagcacuuuggguucgaauuuuccccuaccagcucuuaccaggaccucuccgauuucuaucgcgaggucgaaccgcagggauaccaagugaaauuuguugacauuaacgccgaguacaucgaugagcugguggaacagggccagcuuuaucuguuccaaauuuacaauaaggacuucagccccaaagcccacgggaagccuaaccuccauacgcuguauuuuaaagcucuguucucugagaauaaccuugcgaaucccaucuacaagcucaacggcgaagccgagaucuuuuaucggaaggcuucccuggauaugaaugaaacaaccauucacagagccggagagguccuggagaacaagaauccugacaaccccaagaaacgccaguucguguacgauaucauuaaggacaaacgguauacccaggacaaguuuaugcuccauguuccgaucacaaugaauuucggcgugcaggggaugaccauuaaagaauuuaacaagaaggucaaccaaagcauccagcaguacaaugaugugaacgugaucggaauugacagaggcgagcgccaucugcuuuaccugacaguuaucaauuccaaaggggaaauucucgagcagcggucucugaacgauaucauuacgaccagcgccaauggaacacaaaugaccacaccuuaucacaagauccuggacaaaagagaaaucgagcgccuuaacgcucgggucggcuggggcgagauugaaaccaucaaggagcugaaauccggguaccucucucacguggugcaccagauuagccagcugaugcucaaguauaaugccaucgucgugcuggaagaucuuaacuucggauuuaagagaggccgcuucaaaguugagaagcagauuuaccaaaauuuugagaacgcgcugaucaaaaagcucaaucaucuggcucugaaagacaaggccgaugacgaaaucggguccuauaagaacgcccuucagcugacgaauaacuucaccgaucucaaaagcauuggaaagcagacaggcuuccuguuuuacgugcccgcuuggaauaccucuaaaaucgacccugccacaggguucgucgaucuccugaagccccgguaugagaacauugcgcaaucccaggccuuuuucggaaaauuugacaagaucuucuacaacgcugacaagggcuacuuugaauuuuauguggauuacgccaaauuuaccgacaaggcuaaaaauagcagacagacguggguuauuugcucucacggggauaagcgguauguguacgacaaaacagccaaccagaauaagggcgcuaccaucggaauuaacgucaaugaugagcuuaaaucccuguucgcccgcuaucauaucaacgacaagcaaccuaaucucgugauggauaucugucagaacaaugacaaggaauuucacaaaagccugauguaccugcuuaaggcgcugcucgcccugagauauucuaacgcuagcuccgaugaggacuucauucucagccccguugccgaugacaaaggcguguuuuucaauucugcucuggccgaugacacacagccgcagaacgccgacgcuaauggggcguaccacaucgcccuuaagggacuguggcugcucaacgagcugaaaaauuccaacgaucuugacaagauuaagcuggcuaucgauaaucaaaccuggcucaacuucgcccagaaccgguga

SEQ ID NO: 4628 - RNA, 3903 nt, Artificial Sequence; identical to SEQ ID NO: 4623
  Cpf1 variant

SEQ ID NO: 4629 - RNA, 3756 nt, Artificial Sequence
  Cpf1 variant
augaaccacaugaagcaguucaccaaucaauuuagccuguccaaaacacucagauucgagcugaucccccagggcaagacgaaagaauuuauugagaucaacgggcuuauugaaaaggacaaugagcgggccgugucuuacaaaaaggucaagaaaaucauugaugaauaucauaaguacuucaucgagaugguucugugcgacuuuaaacuccacggacuggagaccuaugaaacaaucuucaacaagaaagagaaggaugacaccgauaagaaagaauuugacaauauucgcaacagccuuagaaagcagaucgcugaugccuucgcgaaaaauccuaacgacgagauuaaggagcgguuuaaaaaucuguucgcuaaggaacucaucaaacaggaucugcugaacuuuguggacgaugagcaaaaggaacucgugaaugaguucaaggacuuuacaaccuacuucacaggcuuccaucagaaccgcagaaauauguaugucgccgaugaaaaagccaccgcuauugccuaccggcuggugaacgagaaucuuccgaaguuuaucgacaaccugaaaauuuaugagaagaucaaaaaggacgcucccgaacucaucuccgaucugaacaagacgcuuguugagauggaagagauugugcaggggaaaacccuggacgaaaucuucucucucagcuuuuucaaucagacacugacccaaacaggaauugagcuguacaacaucgucauuggcgggcgcaccgccgaugagggaaagacgaaaaucaagggccucaaugaauacaucaacacagacuauaaucagaaacagaccgauaagaagaaaaagcaggcgaaauuuaagcaacuguacaaacagauucuuuccgacagacacucugugagcuucguugccgagacauuugaaaccgaugcucagcugcucgagaacaucgaacaauucuauuccagcgugcuguguaauuacgaggacgauggccauaccacaaacauuuuugaggccaucaagaaucuuauuaucgggcugaagacguucgaccucucuaaaaucuaucugcggaacgauaccucccugacagacauuagccagaagcucuuuggagacuggucuaucauuuccagcgcucugaaugauuacuaugaaaaacagaacccuaucucuuccaaggagaaacaggaaaaguacgacgagcgcaaagccaaguggcuuaagcaagauuucaauauugagaccauccagacagcgcugaacgaaugcgacagcgagauuaucaaagaaaagaauaacaaaaacaucgucuccgaguacuuugccaagcucggccuggauaaagacaauaagauugaucuucugcagaagauccaccacaacuauguggugauuaaagaccuccugaaugaacccuacccugagaacaucaagcuggggaaucagaaagagcaagucucucagauuaaggauuuccucgacagcauccugaaccuuauccauuuccugaaaccccucucccugaaggauaaggacaaagaaaaggaugagcuguuuuauagccuuuucaccgcucucuuugaacaccugucucagacgauuuccaucuacaauaaaguuagaaacuaucugacacagaaggccuacagcaccgagaaaauuaagcucaauuucgaaaacucuacccugcuuaauggaugggacgugaacaaggagccugugaauacaagcgucaucuuucggaaaaacggccuguucuaucucgggauuauguccaagucuaauaaccgcaucuuugagagaaacgugccgguuuguaaaaaugaagagaccgcuuucgaaaagaugaacuacaaacugcugcccggagccaauaagaugcuuccuaaaguguuucucagcgccaagggcaucgaguccuuccaacccagcgcugaaauucagucuaaguaccagaaagagacacauaagaaaggcgacgcguuuguccggaaggauauggagaaccugaucgacuucuuuaaacaguccauugccaagcacacggauuggaagcacuucaaucaucaauucagcaaaaccgaaacauauaacgaccugucugaguuuuacaaggaaguggagaaacagggguauaagcucaccuucacaaaacuggaugagaccuacaucaaucagcuuguugacgaaggaaagcuguaucucuuucaaauuuacaacaaggauuucuccccuuuuagcaaaggcaagcccaauaugcacacgcuguauuggaaaaugcuguucgacgagcagaaccuucagaauguggucuacaagcucaacggggaagcugagguguuuuuccgccaguccucuaucaaacaaaccgauagaaucauucauaaggccaaucaggccaucgacaacaagaauccgcugaacaacaaaaagcagagcuccuuuaauuacgaucugauuaaagacaagcgguucacacucgauaaauuucaguuccacgucccuaucacccugaacuucaaggcugaaggaaaugaguaucuuaacacaaaggugaaugaguaccugaaaucuaacagcgacguuaagauuaucggccucgacagaggggaacgccaucugauuuaucugacccuuaucaaucaaaaaggagagcuccugaagcagcagucccugaacgugaucgccacgagccaggaacacgagacagauuacaaaaaucuccuggucaacaaggaaaaugagcgggcgaacgcuagacaagacuggaaaaccauugagacaaucaaggaacuuaaggagggcuaucugucucaggugguucaccagauugccaccaugaugguggaugaaaaugccaucgucgugauggaggaccucaacgcuggcuuuaugcgcgggcggcaaaaaguggaaagacagguuuaccagaagcuggagaaaaugcugauugagaaacuuaauuaucuggucuucaagaacaaugaugugaacgaaaccgccggagugcucaacgcucugcagcucacaaauaaguuugaguccuucgaaaagaugggcaaacaaagcggguuucuguucuacguccccgccuggaacacgucuaagaucgacccugcgaccggauuuguggauuuccuuaaacccaaguacgaguccguugagaaagccaagcuguuuuucgaaaaguuugagagcaucaaauucaaugcugacaagaacuauuuugaauuugaguucgauuacaaaaaguucacagaaaaagccgagggcucucagaccaaguggacagugugcacccauagcgacguccgcuaucgguacaauccccagacgaaggcuuccgaugaggugaacguuacaaaugaacucaaacugauuuucgacaaguuuaaaaucgaguauaagaacgggaaaaaucugaagaccgaacuucugcuccaggacgauaaacaacuguucagcaagcuccugcacuaccuugcccugacccucaugcugagacagucuaaguccggcacagacauugauuuuauccugagcccuguggcgaaaaacggagucuucuaugacucccgcaaugccaugccgaaccuucccaaggaugcugacgccaauggcgcuuuucauauugcccugaaagggcucuggugugugcagcagaucaagaaagccgaugaccugaagaagaucaaacucgcuauuucuaacaaggaguggcugagcuucguucaaaaucuuaaauga

SEQ ID NO: 4630 - RNA, 4173 nt, Artificial Sequence
  Cpf1 variant
augaucgacaacaccaaggagaaaaaggaaggcagcguguucgauggguuuacaagaaaauaccagcuguccaagacgcuccgguucgagcugcgccccauucuuaauaccccuaaaaugcuggacgaugaacaagucaucaagaacgacgagacaagacggaagaaauaugaagccguuaagccgugguuugaucagcuccaccgcgaguucauugaggacgcucugaaaucuuuuaaguucaaaaaucuugccaucuaccaggauaccuuucagacauggcaaaaggacagaaagagcaaacagaagaaagauacccuggugaagauugaagugggacuccgggaggaaaucguccgcagauucgaggagguggcgaacaucuggguucgguccgaacaguauaaacugcugggcauuaagaaagaggggcucggaaugcuguuugaagcuggcguguuccgccuucugaaggagagauuuaagaaugaaaaagacacaaccgucgaugggaacaauaucuucgacgaguggacgcgguggaccggauacuuuaagaaauucuucgagacacgcaagaacuuuuauaaaucugaugacaccagcacagccauugccuacagagugaucaaucagaaccuccggcgcuucugcgaaaauauucaaaucuuugagaagauuuccgaaaagaucgaguucucugaaguugagaaaucuuuugacaucuccugugcuggcauuuucagccuggccuauuacaacgcuugccuucugcagggcgggaucgauaccuacaauaagauuaucggaggcgagguggacgaaaaagauaagaaaauucccgggaucaacgagcucaucaauaaguauagacaggacaacucuggagaaaagauuccuuuucugaaacagcuggauaagcaaauccauuccgccaaagaggcguucauugaaagcaucgagacgaacaaggagcucgucggcaaacugaagacauuuuacgaaaaugccgaggugaagauucagucuuuccggaaccuuaucgcugacaucgugaccgauuauuccggguacgacauugauaaaaucuaucugacaaaggaagccgucagccacaaugcuucuagaugguuugccuccuucgagagcuuugagcgcgaccucuucgcgguuguggccgaaaaacagaacaagcugguguacgagcuucugcggacccauaaaaaugauuccaagauuucugacaaagacggaaaguucagcuuucccgauuucaucaaguguucccacauuaaaagagcucucgaaaagcaagagggccgcaucuggaaaggcgaauauuacgaggacauugucgauuuugagaagaucaaagacguguucacccaguuucugugcguuuucaaguuugaacuggagcagcaguucuuucggaagacaacgagcgcccaaaccggggaacagacaaaaaucggauacgagauuuucgugaccaagaucaacgaacucauuacaagagagaauccugucaucgaucuggaggagaaaauugcuaucaagaacuuugccgacgccacccuucugaucuaucagauugcuaaauacuucgcgguggaaaagcgccggggcuggcucgauaauuaugaccuggaugacagauuuuacaagucuuccgauaucggguaucuuaacuucuaccgcgacgccuucgaacagauuguucggcccuauaaucuguuuagaaacuaccucacgaaaaagccuuacaauacaaacaaaugggugcugagcuucgagaauccgacccuggcugauggaugggacaagaacaaagaaaagaccaacgccgccgucauccuccgcaaggacggccgguauuaccuggggauuaucaaagaggauuguaagucucuuuuugcugacagauauagcaaagagauguccgaaggaaucgagucuggcagcuuccaaaagauggccuacaaauuuuuccccgaagcguccaagaugauuccuaaaugcagcacacagaccaagaaugugaaggagcauuuucggaaaucuuccagcgauuauaaccuguuccacgagaaggacuacaaaaucucugucgcuauuacaaagaauaucuaugaacucaacaauguguuuuaccgcaaagauaacauugaggaauccuucguucccaagaaugacuuugagaagaaacugggcgugaagaaauuccagagacaguaccuggaaaucagccgggauaacaauggguauaagcaagcccuugcccaguggaucgaguucuguauuagauuucucaaggcuuacaaauccacgaccaucuucgacuauucucgccugcgggaggccaaggaauacgagagccuggaugcuuuuuaucaggacauuaacgcccucacauacaauaucuccuucgucccuauuucugaacaguauaucaaagagaagaacgauaauggagaacuguuucuuuucgagauuuacaacaaagacuggagccugggccccauggauaagaauagaaaacgcaccaagaaccuccacacacuguacuuugagcaacuguucuccaaggaaaacgagcaggaaaauuuucuuuuccagcucaacggggaggcggaacuguuuuucagaccgaaaaccgaggagaagcggcugggauauaaagugugggacgccggcgaaaagaaauggguuaaggcuaaggagaaagaagacggggccgugaucgaucgcaagagauacgcuaaagacaucauucucuuucauugcccuaucacgcugaaucgggucagcgagucuaagaccaaacgcgagauggauguggaaauuagagaggugcuuuccagcacacccggcguucacaucauuggagucgaccggggcgaaaagcaucuggccuauuacucugugaucgaucaaaacgggaaaaucauugagaccgacacacucaauuccaucggaaaggauggccgcgggaagccuguggaauaugcgagcaaacuggagaagagagcccaggagcgggaagcuagccgcagagacugggaggaagucgaggccauuaaagaucugaagaaaggauacaucagccaggugauucggaaccuugcugaccucaucaucaagcacaaugccauuaucguuuucgaagaucugaacaugagauucaagcagauucgcggcgggaucgagaaauccgccuaucaacagcuggagcgggcucucauugacaagcugagcuuucuugugaaaaagggcgaagaggaccccaaacagaccggacacauccugagagcguaccagcucgccgcucccgucauugccuucaaggauaugggcaagcaaacggggcugaucuuuuacacacaggccggauauaccucuaaaacauguccugaaugcggcuaccgccggaauaucaagugucuguucgagaacauugaacaggcuaaaacccuuaucgagaaucucgaguccauuaacuauaauaagaaagaagacguguuucagaucagcuacucccuggagaagcugucuagcaaggaucagaaaaaggagaaaaagguuuccaacgaacucuaugccaaaacccugaagaaagacauuuucauccuuacaacgaagaaugcgcugagauacaagugguaugaucgcuacucugagaaagcuaagguggccaaacgggggaucgacgaauacaagggagaggucaacgaaagcgagaccaaaaagggcgugguuaaggaauuuaaccucacagaguaucugaaagggcugcuuaagaccuacgagauugauuaugaacauggcggaaucagagagcaaauucuguccguggcccgcggccgggaguucuacaaagacuuucucuaugcucuguuccuccugacagaaaccagacacucuaucagcgggcggaauacggauuacauucagugcccggaaugcgaguuugacucccgcaagggauucaaagauaucaaggaguuuaacggcgacgccaauggggcguauaacaucgcuagaaagggaauuaugauccuugaaaagauuaaacaauucaaaaaggauaaugacggcaaccuggagaaaaugggguggggcgaccucagcaucucuauugaagagugggauaaguucacacagaaggaauga

SEQ ID NO: 4631 - RNA, 4026 nt, Artificial Sequence
  Cpf1 variant
augaacgccgagaagaaaugcgcuuucaaugaauuuaccaaccuguacgagcucagcaagacacugaaauucgaacuuaagcccgugggcaaaacgaaggagaucauuaagaauuuuagagaggaacuggagaaaaacaauccuauccagcucgacaaggaaauuuccaucgccaaacaagagauuaagaaagaucuggacauccuucaccgggaauuuguccgccagucuuuugagcuggcguucaaggagaacaagaucaauuaugaaauuuucuucgagaucuacagaaacuuuaaaaaguucagcaaaaauaagaaauccgaugaauauauugcugccaucaagaaccucaaagaggaaaagauuaagcugguuaaaaagaucgccgacuacuuugugaaaauggaucaggaguggcggaaguauuacccgucugagaaaaagagcuuccugcucauguccaauggggugauuaaccugcuuaucgacaucaauaaggaucgcauggacuauucuuuuauucccaaagaagucugugagaagaucaaaggaaagggcaaaauugaacuguacgagaaguucaacaagcauuucggguaccucagcaaauauaauaccgcuagagaaaacuuuuacuccgaugacgugaagaacagcgccucuguugcuuaucgggccaucugcgagaaucuggagaaauucugugauaacaagauuaaaguggaagcggacaauuuuccuaaggagaucaaggaaaaauuccuugaguacuuuaacaagaucacagaucuguccuucuauaaucgcugccucagccagaacggaauugaagaguaccacaaauuuaaggacgagaucaauagaucuauuaacgaacuguaucccaauaacuccaaaaauaagccucaaaacauccccuaccugagcaaacucgacaagcagauucugucugagaaggauaaacaguccuggaucgaagagggcuucaucgacgagaauaacuuuauuuucgaauuugagaaguucaucaaaaugaaugauaaguacauuccuagcgaaaagaaacuuuuuaacgaguucuucaucuuucagaacaaugacgaaguccugcaaaaacucuuccugcuuaaaaagaccauuaacaauuuugccaacaucuaucuggaugacccgaaaaaucucauggaucugaugcccuccaaggggacaaagaagcgggacuaccugucucuccuggagauuaaggaggcucuuaacagcuaugccgaaaaucagaacaucggagagacccagaucuucaaaauuaaguacgaugacgugaucgauaaaacaaagaccccuuuugaauguuucaugaaaauuuggaaguaugaguacgaccugcucuauaaugaaggcgacggcaagaaaaacaucgaggaggggugggaaaagauuugcgagaaacugcagaauaagaaagaugaauuuacgggagacuacggcaaguacaaaaaggagaucaaggauuauugugaaauggcucuuucccugagccaacgcaucaaacaucucgacauuagaaucaagaaacgggaugggucugaggacgccgauaacaaucuguucgagggaguugaaaagcuggacgaguuuuacgaucgccucuucgaaauuguggacgagcacaacgcguaucaguaccaucacgaguuucaggccuuccugaccaaaaagcccuauaagacagauaaauuuaaacuuuccuucgacaauccucaacugcucaagggcugggaucugaacaaggaacccgacuacuucggggcucugcuugucaaaaacgagaaguauuuucucgccguguuccacaagcaguacgcuaaugaaaucuuuagacagaaaaacaagaauagcaccgugaaaauuaaggaggccuacgacgucuucaacggaaauuauuacaaaaagguugaacugaagcagaucccgaaacuguuuaugaaccucccucggaucugcuucgccaagucuaaucaagaggaguuuggccugacaauugaacuugagaaaaucaagagcgaguucgauaaauuucagaagcugaagaaagaacgccaggacaacaaucucaaguucgaucaggaaaaauuuauuaagcugcuggcuuauuacagacauugucuugagauccgggaggacuggaaaguguucaaguauaacuucaaaccccucuacaaguauuccaaucugggcgaauuuuacagagaucuggagaaggacaccuacaaccucgaucuggugcgcgucaauucugaauauguggagaaaaagcggaacgaagggaaacuuuaccuguucgagguuuauaauaaggacuuuagcgauaaauccauuggaagaaagaacauccacagcgacuacuucaagucucucuuucugccugauaaccugacgaauaaaaagaucgcgcuugccgcugacgccgagauuuucuuucgcgaaaaaucccucaagaacaaagaugagaucauuacacaaaagaauaagaucaaaauugacaagaacaaucauaaaggcgaaaaggccuauagcaaaaaccgguacaccgacgauaagaucauucugcaucugcccaucaaucucaacuucggggagaauaagaaccacaaagacuuuaauuaugagaucaacgauucucugcuuaagaauaacagagacauuaaaaucauuggaaucgaucgcggcgaaaaguaccugcucuacuauuccgugauugaccagaaaggggauaucaaggagaugggagacuucaaugucgugaacggcguugauuacuauagcaaacugguggcuuacgaagagaagcggaagcaggccagacuggacuggggcgauauccaguccauuaaagaacuuaaggagggguauaucucucacgucauucacgagaucugcgaccucauuaaaaaguacaaugcgaucgugguccuggaagaccugagcaugggauuuaaacgcggccgguucuuuagagagcgccaaguguaucagaaguucgaacucgcucuguuccggaaacuuaacuacuggguugauaagaacaaggaggaaggggagaaaggauccgcccugucugccuggcagcucacacccaaugagaaggacuuuaaagugagccagcuggaaaaggcuagacaacugggcauccuuuucuacaccgccgcuggguauaccuccaagacauguccugauugcggcuuucggaaaaacauuacgcugaaguacgucaaugacaaacagcucaaggaggaucugggaaaacucaagaucaacuucguggaagaccauuuuaagauuaaauauaaucugcuugauuucgagaagaacaaaaagagcgaaaaagccaaggacaccguucugccgaaagaggagcgcaagaucucuuuuguggccaauuccaaggucauuagaauccgguggcacgauauuaaaacaaagcucgcgaaaagagaacuggacggcgagaagaucaucaaaaaguuccccaagggggugauuaaagaauacgauaucaacauuugccugaagcgcaucauuggagacaaaaucgauuuuagcaaggacucuaucaccgagcagcuuauuaauggccgguucgggaaagacuuuuauugggagcugauguacuuccucaaccugauccucgaaauuagaaaugugguuuccgagacagaaaucgauuauauucaauguccugucugcggauuucauagcgacgauggcuuccgcgggaacaaguucaauggcgacgcuaacggagccuacaauaucgcuagaaagggccggcugauccuugagaaaauuaaccagcacaagaaccugaaagaacucaagaccggggaucugucugugaauaucguggagugggacaaagccgucaacaauugggauaaguuugugcagggagacaacacggagagcaagaauauugaaauccccgcgaaagaggaaaugauuuccguugaggugcgcgaaagcuga

SEQ ID NO: 4632 - RNA, 4107 nt, Artificial Sequence
  Cpf1 variant
augaagaaagagaaggaguucaaaucuuuuggcgacuucaccaaccuguacgaaaucuccaagacacucagauuugaacugaaacccguggagaauacgcagaccaugcuugaugaagccgacgucuucgggaaggauaagguuauuaaagacaaguauacaaaaaccaagccuuuuaucgauaaacugcaccgggaguucguggacgagucucucaaggaugugagccuguccggacuuaagaaauacucugaaguccuggagaacuggaagaaaaauaagaaagacaaggauauugugaaagaacucaagaaggaggaggaacgccugagaaaagagguuguggaauuuuucgacaacacagcuaagaaaugggccaaugagaaguauaaagaacugggccucaagaagaaagauaucgggauucuguuugaggagagcgucuucgaccuucugaaggaaaaauacggagaggaacaagauuccuuucucaaggaggaaaaaggcgacuuccugaagaacgagaagggggagaaagugucuaucuuugacgaauggaagggauucguuggcuauuucaccaaauuucaggagacacggaagaauuucuacaaaaacgauggcaccgaaacggcgcuugcuacccgcaucauugaccagaaucugaagagauuuugcgauaacaucgacgauuucaagaaaauuaagaauaaaaucgacuuuagcgagguggaaaagaacuucaauaaaacagccgaugucuuuucccucgacuucuauaaccagugucugcugcaaaaggggauugauagcuacaaugaguuuaucggaggcaaaacccucgagaacgggaagaagcugaaaggagugaacgaacuugugaaugaguaccggcagaagaacaaaaaugaaaaggucucuuuccugaaacuccuggacaagcagauucuuuccgagaaggagaaacugagcuuuggcaucgaaaacgaugagcagcuccugguugugcugaauagcuucuaugaaacagccgaggaaaagaccaaaauccuccgcacgcuguuuggggacuucguggagcauaacgagaauuacgaccuugauaagacauauauuuccaaagucgcuuucaacaccaucagccacaaguggacaaaugaaacccauaaguuugaggaacugcucuacggagccaugaaagaggacaagccgauuggccugaacuaugauaaaaaggaagacucuuacaaauuccccgauuuuaucgcucuuggcuaucugaagaagugccucaauaaccuggacugugauaccaaauucuggaaggagaaauacuacgagaauaacgccgacaagaaagauaaggacaaaggguuucugacaggaggccaaaaugcgugggaucaguuccuccagauuuuuaucuucgaauuuaaccagcuguucaacuccgaggccuuugacaauaaggggaaggaaaucaaaauuggauaugauaacuucagaaaggacuuugaggaaaucauuaaucaaaaagacuucaagaacgaugagaaucuuaaaaucgcuauuaagaacuucgccgacagcgugcuguggaucuaccagauggcuaaguauuuugccaucgagaaaaagcggggcugggaugacgauuucgaacucuccgaguuuuacacgaauccuucuaacggguauagccuguucuacgaccgcgcguaugaagagauuguucagaaauacaaugaucugagaaacuaccuuaccaagaaacccuauaaggaggacaaguggaaacucaauuuugaaaacccuacacuggccaauggauucgauaagaacaaagaguccgacaauagcaccgugauccugcggaagaaacgcaaguacuaucucggccugaugaagaaaggcaacaacaagauuuuugaagauagaaauaaagcugaguucauccggaacauugaaucuggggccuacgagaagauggcuuauaaauaccuucccgacgucgccaagaugaucccuaagugcuccacacaacugaaugaggccaaaaaccacuuucgcaauagcgcugaugaccucgaaauuaagaaaucuuucagcaacccgcugaagaucaccaaaagaaucuuugaccugaauaacauucaguaugauaagacgaauguguccaaaaagaucucuggagacaacaagggcauuaaaaucuuccagaaggaguacuacaaaauuagcggggauuucgacguuuauaaguccgcgcuuaaugauuggaucgacuuuuguaaagauuuccucagcaaguacgacucuacaaaggauuuugacuucuccauccugcggaaaaccaaggauuauaaaagccuggacgaauuuuacguggacgucgccaagauuaccuauaaaaucucuuucacacccguguccgagagcuacauugaucagaagaacaagaauggagaacucuaucuguuugagaucuacaaccaagacuucgcuaaaggcaagaugggggccaaaaaucuucauacccuguacuuugagaacgucuucuccccugaaaacauuucuaagaauuuucccaucaaacucaacggcaaugccgagcuguucuuuagaccuaagagcaucgaauccaagaaagagaagcgcaacuucgugcgggaaauuguuaauaaaaagagauauucugaggauaaaaucuucuuucacugccccauuacacugaaccgcgagacgggaagcaucuaccgguucaauaacuaugugaauaacuuucuuuccgaaaauaacauuaauaucaucggcgucgacagaggggagaagcaccucgcuuacuauagcgugauugauaaaaacggaguuaagaucggcgggggaucuuucaaugaaauuaacaagguggacuacgccaaaaagcuggaggagcgcgcgggcgaacgggagcaguccagaaaagauuggcaggucguggaagggaucaaggaccugaaaaagggcuauauuagccaggugguucgcgagcucgcugaucuggccaucaagcauaaugccauuaucguccuugaagaccugaacaugcgguuuaaacaaaucagaggaggcauugagaagucuaucuaccagcagcucgagaaagcucugauugauaagcuguccuuccuuguggaaaaaggggagaaggacccgaaccaggccggacacauccucaaggcuuaccaacuggccgcgccuuuuaccagcuucaaagauaugggcaagcagacagggauuguguuuuauacccaggccucuuacacaagcaaaaccugucccaauugcggauuccgcaagaacaauaacaaauuuuauuucgaaaauaacaucggcaaggcucaggacgcccugaagaaacucaagacguuugaguacgacuccgaaaauaaauguuucgggcugagcuauugccuuucugauuucgcuaacaaggaggaggucgagaaaaauaagaacaaaaagcggaauaacgccccuuacuccgacaucgaaaagaaagauuguuuugaacugagcaccaaggacgcggugagauaucgguggcaugauaaaaauacagagcgcggcaagaccuucuuugaaggagaguccguuuacgaggaaaaagaggaaaaggagauuggccaaacaaagagagggcucgugaaagaguacgacaucucuaagugccugauuggacuguucgagaaaaccggccuugauuauaagcagaaccugcucgacaaaaucaauagcgggaaguuugauggaacguucuacaagaaccuguuuaacuaucucaaucugcuuuucgaaauucggaacuccaucucuggcacagaaaucgacuacauuagcugccccgagugucaguuucacaccgauaaauccaagacaaucaaaaauggggacgauaacggcucuuauaauauugccagaaagggaaugaucauucuggacaaaaucaagcaauucaagaaagaaaacggcagccucgacaagaugggguggggagagcuguuuauugaucuggaggaaugggacaaauucgcucagaagaaaaauaacaauaucaucgauaaguga

SEQ ID NO: 4633 - RNA, 4149 nt, Artificial Sequence
  Cpf1 variant
augagcaagaacaaugugugggacaaauucaccaaccaguacucccugucuaagacacucagauuugagcugaaacccgucggcaagacgcgggaaaagaugaaugagcaacuuaaguaugauaagcagcugcagaccuuccucaaagaccaggaaaucgaggaugccuaccaauaucugaagccguuuuucgacaaacuucacaaggaauuuauuacagauagccuggacuccgauaccaccaaaaagaucgacuucucugauuaccucauugacuaucgcgauaagaaagaccugacaaagaaagaggauagccugagaaagaacaucggggagguuuuugugaaagcuggagaccgguggaagaaagaaaaguacccuaaguaugaguggaaaaagggcuccaauguggccaacgggucuggcauucuccugacacaggacguccuuaugcugaucaaagaucucaaucccaacgaccagaagaucaaaaagaugauugaagagaccuucaagggauuuuucacguacuuuagcggguucaaucugaaccgcgagaauuacuauaccacaaaaguggaaaaggcgaccgcuguugccacaagaaucgugcaugauaaccuuccuaaauuuugcgacaaucugguccaguucgaguguauuaucaagaaaaagaagaacggagaaguggaucggauugagcgcaaauccgaauaccucaaugccuaucaauaccucaagagcaaaggcagaaccacgcagaucaaggacgcugagucuggcaaaaugauugaggccgaaguuaucaacgagaacauguucuccaucagcuauuuuucugcuugccugucccagagcgggauugaagaguacaaucggacaaucggacacuauaaccugcugauuaaucuuuacaaccaggccaaggaaggcgaggagaaggaucugaaaaagucugagaaaaaguucaaacgccuccccaucuuuaagacccuguacaaacaaauuggguguggagaaaaggaaccucuuuucuuuucccugacacaugacaccaagcuccaggugcaggagaauaaagaaaacuauaagaaacccuacagcgucgagcaaauccuggagcaggcgaagcuggccggcgauaaauauuucaaggggaaguccaaugacggaauccucaacaccauuccugaauuuucugauuacauccugcagaaagagagcuauggcggcguguacugguccaagguggcuauuaauacaaucagcaacagauauuucgaaaauuggcacacgcuuaaagacgcccugauugacgcuaaggucuuugagaaagggaagaagggagaugaggaagacguuaaaaucccggagucuaucgaacuccagggcuucuuugaugugcuggacacccaagagggguggaaguccgaaggaauuuucuuuaaaaagagccuuacagaggagcugaaaaacaaggaagccgauaccaagaauaaaaagcggcgcgagaucgugaaagaagcgaagagacccucucaggcccuccuggcucuccuguucgacgauauucaggagcaugccaaccuguuccuuaaucagagcgacgaaauccugaaacucgagaaguacuccgagaaagaaucuaaggagaagauuaaacaauggauggauagcgcucuggccgucaaccggauccugaaguacuuuuucgugaaagaauccaaggccaaaggcgagcagauugacccuaucaucagcgaagcucuuaagguucucuuuaacucugaggaugcgacaugguucaagugguaugacgcccugcgcaauuaccugaccaaaaagccccaggaugacgugaaagagaacaagcucaaacugaauuuugaaaacuccacgcuugcugggggaugggacauuaauaaggagagcgauaacuauugcgucauccugcaggaccaaaagggcaaacagcaccucggcauuaucgccaagaaagaaaagcagagaggguacaauaaaauuuucgagcggacaccugagaacccccuguauaagaucgauucuggagaaguguggcagaagauggaguacaaacaaaucgccguuccgaccggcauugggggauuugugagaaaguguuucaauaccgcucagcaguauggcuggaaaugcccugacaacugucuuaauuccgaagggaagaucauuaucaaaaacgaugaggccaaggaaaaucuggaggcgauuaucgacugcuacaaggacuuuuucacaaaauacgagaaggauggcuuuaaauauaagaacuucaauuuuaacuucaaagaaagcgaggaauacgaggaacucaacuccuucuuuucugaugucgagcgccaaggauauaagcugggcuucaucaccgugaauaaaacaauuaucgacaagugggucgaggaugggacgauuuaccuguuugaaaucaagaaccaggacaccaaugauggcaaaaaggacggacacaaaaacaaucuccauacaauuuauuggaaggcucuguucgaggacguggggaacaaacccaaacuuaauggaggcgccgaacuguuuuaccggaaggcccuccugaaagauaagcaggagaaaaucgaagacaacuaugggaaggagaucauuaaaaauuucagauuuagcaaggagaaguuccuguuucacuguccuaucaaacuuaacuacaaggcuaaauccuacucucaucccaaguaugcccuccccgaaauuaauaaacagaccaacgaguucuuuaucacaauuagcgauaucugcuuccugggcauugaccgcggagaaaagcaccuggcuuacuauucccucguuaaucaaaaggaggagaucaucgaucagggcacccugaacaugccuuucguggacaaagaugggaagccgcggagcauuaaaaaggaaaaauuuagauucgacgccaaggucgauaaaugggugucugaggaaauggacuguuggaauuacaacgaucuucuggacgcgauggccuccaaccgcgacauggcucggaagaauuggcagacgaucggaaccauuaaggagcucaaaaacggcuauaucagccagguugugagaaagauugucgaucuggccaucgacaaaaaucgcgggauccccucuuuuauugugcuggaaaaccuuaaugcuggauucaugcggggcagacaaaagaucgagaaauccguguaccagaagcucgagcuggcccuggcgaagaaacucaacuuuguugucgauaagacagugcagaauggggaaauuggcagcgugaccaacgcccugcagcuuacaccucccgucaccaauuuccaaaacaucgagaaucgcaaacaggugggaauuaugcuguauacgcgggcugacuacacaucucagaccgauccuguuacaggcuggagaaagagcaucuaccucaaaaagggguccgaagaguauaucaagagccaaauuauggacucuuuugaugacuucggauuugauggcaaaaacuacuauuucaaguacaccguggaccugaucgaucccauuaaaaagaccuccgagaaaaaguuuaagaaacaguggacacuguauagcgggaucaauggaaagucccuugaccgguuccgcggcgaaagaucuagcgauaaaaacgucuggauuaagacgcugcaggacaucaaaaccacacucgacgccguguuuauuggguucgaucugcagcacucccuccggucucaaaucaucaaugacggcauuaugccgaagaaaaucgagaacagccaguucaccggaugggaaucccugagauuugcuauugagaugauccagcagauucgcaauaucggcguugaaaagggggaugaggacuucauccuuucuccugugcgggauaagaacgaaaaccauuuugacagcagaaaagccaaggagaaugagcccaacuccggagaugccaauggcgcuuacaacauugcgcgcaaagggaucauuaugaaugaacacaucaagaaagaccugauuccuuucauccaagauaaggagugggacgccuggcucgcuggaagagaagucugggauaaguggcugaucgagaacaaagacagccugauuuauaagaaauga

SEQ ID NO: 4634 - RNA, 4203 nt, Artificial Sequence
  Cas9 variant mRNA product
auggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauga

SEQ ID NO: 4635 - RNA, 4986 nt, Artificial Sequence
  Cas9 variant mRNA product
auggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguga

SEQ ID NO: 4636 - RNA, 3258 nt, Artificial Sequence
  Cas9 variant mRNA product
auggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauga

SEQ ID NO: 4637 - RNA, 4326 nt, Artificial Sequence
  Cas9 variant mRNA product
auggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauga

SEQ ID NO: 4638 - RNA, 3402 nt, Artificial Sequence
  Cas9 variant mRNA product
auggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauga

SEQ ID NO: 4639 - RNA, 4263 nt, Artificial Sequence
  Cas9 variant mRNA product
auggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauga

SEQ ID NO: 4640 - RNA, 3345 nt, Artificial Sequence
  Cas9 variant mRNA product
auggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguga

SEQ ID NO: 4641 - RNA, 4101 nt, Artificial Sequence
  Cas9 variant mRNA product
auggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauga

SEQ ID NO: 4642 - RNA, 4134 nt, Artificial Sequence
  Cas9 variant mRNA product
auggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguga

SEQ ID NO: 4643 - RNA, 3267 nt, Artificial Sequence
  Cas9 variant mRNA product
auggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauga

SEQ ID NO: 4644 - RNA, 3345 nt, Artificial Sequence
  Cas9 variant mRNA product
auggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguga

SEQ ID NO: 4645 - RNA, 3351 nt, Artificial Sequence
  Cas9 variant mRNA product
auggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauga

SEQ ID NO: 4646 - RNA, 3051 nt, Artificial Sequence
  Cas9 variant mRNA product
auggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauga

SEQ ID NO: 4647 - RNA, 3462 nt, Artificial Sequence
  Cas9 variant mRNA product
auggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauga

SEQ ID NO: 4648 - RNA, 4020 nt, Artificial Sequence
  Cpf1 variant mRNA product
auggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguga

SEQ ID NO: 4649 - RNA, 3999 nt, Artificial Sequence
  Cpf1 variant mRNA product
auggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauga

SEQ ID NO: 4650 - RNA, 4716 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4651 - RNA, 5499 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4652 - RNA, 3771 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4653 - RNA, 4839 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4654 - RNA, 3915 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4655 - RNA, 4776 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4656 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4657 - RNA, 4614 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4658 - RNA, 4647 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4659 - RNA, 3780 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4660 - RNA, 3858 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4661 - RNA, 3864 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4662 - RNA, 3564 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4663 - RNA, 3975 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4664 - RNA, 4533 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4665 - RNA, 4512 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4666 - RNA, 4813 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4667 - RNA, 5596 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4668 - RNA, 3868 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4669 - RNA, 4936 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4670 - RNA, 4012 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4671 - RNA, 4873 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4672 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4673 - RNA, 4711 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4674 - RNA, 4744 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4675 - RNA, 3877 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4676 - RNA, 3955 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4677 - RNA, 3961 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4678 - RNA, 3661 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4679 - RNA, 4072 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4680 - RNA, 4630 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4681 - RNA, 4609 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagugaagggaacacccaaauuuaauucagccuuaagcacaauuaauuaagagugaaacguaauuguacaagcaguuggucacccaccauagggcaugaucaacaccgcaaccuuuccuuuuucccccagugauucugaaaaaccccucuucccuucagcuugcuuagauguuccaaauuuaguaagcuuaaggcggccuacagaagaaaaagaaaaaaaaggccacaaaaguucccucucacuuucaguaaauaaaauaaaagcagcaacagaaauaaagaaauaaaugaaauucaaaaugaaauaaauauuguguugugcagcauuaaaaaaucaauaaaaauuaaaaaugagcaagaucuaaaaaaaaaaaaaaaaaaaaaaaaaaaaaaaaaaaaaaaaaaaaaaaaaaaaaaaaaaaaaaaagaauu

SEQ ID NO: 4682 - RNA, 4497 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4683 - RNA, 5280 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4684 - RNA, 3552 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4685 - RNA, 4620 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4686 - RNA, 3696 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4687 - RNA, 4557 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4688 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4689 - RNA, 4395 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4690 - RNA, 4428 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4691 - RNA, 3561 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4692 - RNA, 3639 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4693 - RNA, 3645 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4694 - RNA, 3345 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4695 - RNA, 3756 nt, Artificial Sequence
  Cas9 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4696 - RNA, 4314 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4697 - RNA, 4293 nt, Artificial Sequence
  Cpf1 variant mRNA product
gggagagcggcucggccauuuugucccagucaguccggaggcugcggcugcagaaguaccgccugcggaguaacugcaaagaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4698 - RNA, 4439 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4699 - RNA, 5222 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4700 - RNA, 3494 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4701 - RNA, 4562 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4702 - RNA, 3638 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4703 - RNA, 4499 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4704 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4705 - RNA, 4337 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4706 - RNA, 4370 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4707 - RNA, 3503 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4708 - RNA, 3581 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4709 - RNA, 3587 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4710 - RNA, 3287 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4711 - RNA, 3698 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4712 - RNA, 4256 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4713 - RNA, 4235 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4714 - RNA, 4420 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4715 - RNA, 5203 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4716 - RNA, 3475 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4717 - RNA, 4543 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4718 - RNA, 3619 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4719 - RNA, 4480 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4720 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4721 - RNA, 4318 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4722 - RNA, 4351 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4723 - RNA, 3484 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4724 - RNA, 3562 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4725 - RNA, 3568 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4726 - RNA, 3268 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4727 - RNA, 3679 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4728 - RNA, 4237 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4729 - RNA, 4216 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4730 - RNA, 4530 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4731 - RNA, 5313 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4732 - RNA, 3585 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4733 - RNA, 4653 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4734 - RNA, 3729 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4735 - RNA, 4590 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4736 - RNA, 3672 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4737 - RNA, 4428 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4738 - RNA, 4461 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4739 - RNA, 3594 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4740 - RNA, 3672 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4741 - RNA, 3678 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4742 - RNA, 3378 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4743 - RNA, 3789 nt, Artificial Sequence
  Cas9 variant mRNA product
gggagaggcgcugccuacggagguggcagccaucuccuucucggcaucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4744 - RNA, 4347 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4745 - RNA, 4326 nt, Artificial Sequence
  Cpf1 variant mRNA product
gggagaggcgcugccuacggagguggcagccaucuccuucucggcaucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4746 - RNA, 4582 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4747 - RNA, 5365 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4748 - RNA, 3637 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4749 - RNA, 4705 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4750 - RNA, 3781 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4751 - RNA, 4642 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4752 - RNA, 3724 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4753 - RNA, 4480 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4754 - RNA, 4513 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4755 - RNA, 3646 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4756 - RNA, 3724 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4757 - RNA, 3730 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4758 - RNA, 3430 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4759 - RNA, 3841 nt, Artificial Sequence
  Cas9 variant mRNA product
ggggcgcugccuacggagguggcagccaucuccuucucggcaucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4760 - RNA, 4399 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4761 - RNA, 4378 nt, Artificial Sequence
  Cpf1 variant mRNA product
ggggcgcugccuacggagguggcagccaucuccuucucggcaucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 4762 - RNA, 4484 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4763 - RNA, 5267 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4764 - RNA, 3539 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4765 - RNA, 4607 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4766 - RNA, 3683 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4767 - RNA, 4544 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4768 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4769 - RNA, 4382 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4770 - RNA, 4415 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4771 - RNA, 3548 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4772 - RNA, 3626 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4773 - RNA, 3632 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4774 - RNA, 3332 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4775 - RNA, 3743 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4776 - RNA, 4301 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4777 - RNA, 4280 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4778 - RNA, 4581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4779 - RNA, 5364 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4780 - RNA, 3636 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4781 - RNA, 4704 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4782 - RNA, 3780 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4783 - RNA, 4641 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4784 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4785 - RNA, 4479 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4786 - RNA, 4512 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4787 - RNA, 3645 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4788 - RNA, 3723 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4789 - RNA, 3729 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4790 - RNA, 3429 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4791 - RNA, 3840 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4792 - RNA, 4398 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4793 - RNA, 4377 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuaguaauaaggaaacuguaugaaugucugugggcaggaagugaagagauccuucuguaaagguuuuuggaauuaugucugcugaauaauaaacuuuuuugaaauaauaaaucugguagaaaaaugagaucuaaaaaaaaaaaaaaaaaaaaaaaaaaaaaaaaaaaaaaaaaaaaaaaaaaaaaaaaaaaaaaaagaauu

SEQ ID NO: 4794 - RNA, 4517 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4795 - RNA, 5300 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4796 - RNA, 3572 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4797 - RNA, 4640 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4798 - RNA, 3716 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4799 - RNA, 4577 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4800 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4801 - RNA, 4415 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4802 - RNA, 4448 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4803 - RNA, 3581 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4804 - RNA, 3659 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4805 - RNA, 3665 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4806 - RNA, 3365 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4807 - RNA, 3776 nt, Artificial Sequence
  Cas9 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4808 - RNA, 4334 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4809 - RNA, 4313 nt, Artificial Sequence
  Cpf1 variant mRNA product
gggagagggcgcuuggcuugcaaggacccugagcugcggcauugaagcacacccaacccaacucgacugaagucagccucacugaaccggaucugagaaucuucucucucugggcuugccagggcucuccgaaccuagcuagcauccucuucaauuccaacuagaaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4810 - RNA, 4466 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4811 - RNA, 5249 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4812 - RNA, 3521 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4813 - RNA, 4589 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4814 - RNA, 3665 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4815 - RNA, 4526 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4816 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4817 - RNA, 4364 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4818 - RNA, 4397 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4819 - RNA, 3530 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4820 - RNA, 3608 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4821 - RNA, 3614 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4822 - RNA, 3314 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4823 - RNA, 3725 nt, Artificial Sequence
  Cas9 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4824 - RNA, 4283 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4825 - RNA, 4262 nt, Artificial Sequence
  Cpf1 variant mRNA product
gggagacuccugucgggcggaaguaggaggaguagaguuuaaaaacaguacucuuuuuccgguucgggacguaguugaagcaacgacaagccggauaaccgcucuugagacaggaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaagaauu

SEQ ID NO: 4826 - RNA, 4452 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4827 - RNA, 5235 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4828 - RNA, 3507 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4829 - RNA, 4575 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4830 - RNA, 3651 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4831 - RNA, 4512 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4832 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4833 - RNA, 4350 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4834 - RNA, 4383 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4835 - RNA, 3516 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4836 - RNA, 3594 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4837 - RNA, 3600 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4838 - RNA, 3300 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4839 - RNA, 3711 nt, Artificial Sequence
  Cas9 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4840 - RNA, 4269 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4841 - RNA, 4248 nt, Artificial Sequence
  Cpf1 variant mRNA product
gggagaguccgcucagccagguugcagaagcggcuuagcguguguccuaaucuucucucugcguguagguaggccugugccgcaaacaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4842 - RNA, 4433 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgacaagaaauacagcauuggacuggauaucggcaccaacuccguugggugggcggugauuacagacgaguauaaggugccgucuaagaaauucaagguccucggaaauacggaucggcauagcaucaaaaagaaccugauuggcgcucugcuguuugacuccggggaaaccgccgaggccacacgccucaaaagaaccgcucggcgcagauacacacggcgcaagaauagaaucugcuaucugcaggaaaucuucucuaacgagauggccaagguggaugacagcuuuuuccaccggcuugaagaguccuuucugguugaggaagauaaaaagcaugagcgccaccccauuuucggaaauaucguggacgaagucgcuuaccaugagaaauauccuaccauuuaccaccucagaaagaaacugguggauucuacagacaaggccgaucugcggcucaucuaucuggcgcuugcccacaugauuaaauuucgcggccauuuccugaucgagggcgaccucaaccccgauaauagcgacguugacaagcuguuuauucaacuugugcagaccuacaaccagcuguucgaagagaauccuaucaacgcuuccggggucgaugccaaggcuauccucagcgccagacugucuaaaucccggcgccuggaaaaucucauugcgcagcugcccggagagaagaaaaacggccuuuuugggaaucugaucgcccucagccugggacuuacgccuaacuucaagucuaauuuugaccuggcugaagaugccaaacuccaacuguccaaggacaccuacgaugacgaucuggacaaccuccuggcucagauuggcgaucaguaugccgaccuuuuccuggccgcuaagaaccucagcgaugcgauccugcuuucugacauucugagagugaauacagagaucaccaaagccccgcucuccgcuagcaugaucaagcgguacgacgagcaccaucaggaucugacacugcucaaagcccuggugagacaacagcuucccgaaaaguauaaagagauuuucuuugaccaguccaagaacggguacgccggauauaucgauggcggcgcuucucaggaagaguucuacaaguuuauuaaaccuauccuggaaaagauggacgggaccgaggagcuccuggucaaacugaaucgcgaagaucuucuccggaagcaaagaacguucgacaacggaagcauuccccaccagauccaccugggcgagcugcaugccauccuccgccggcaggaagauuuuuauccuuuccugaaagacaauagagagaagauugaaaagauccuuacauuucgcauucccuacuacguugggccgcuggcgcggggaaacuccagauucgcuuggaugacccgcaaaagcgaggagacaaucaccccuuggaauuuugaagaggugguggauaagggcgccucugcccaauccuucauugaacggaugaccaacuuugacaaaaaucuccccaacgagaagguccugccuaaacacagccugcuuuaugaguacuucacaguguauaaugaacucacgaagguuaaauacgugaccgaggggaugagaaagcccgcuuuucugucuggagaacagaagaaagccaucgucgaucuucucuucaagacaaaccgcaaagugaccguuaagcagcugaaagaggacuauuucaagaagauugaauguuuugauagcguggagaucuccggcgucgaggaccgguucaaugcuucucuuggcacauaccaugaccugcucaaaaucauuaaggauaaagacuuucuggauaacgaagagaaugaagacauccuggaggauauugugcuuacccucacgcuguucgaagacagagagaugaucgaggaacggcugaagacauaugcccaccucuuugaugacaaagucaugaagcagcugaagcgcagacgguacaccggguggggaagacuuagccgcaaacugauuaacggcauccgggauaagcaauccgggaaaaccauccucgacuuccuuaagagcgauggauuugcgaacagaaauuucaugcagcugauucaugacgauucucugacauuuaaagaggacauccagaaggcccagguguccggccaaggggacagccuccacgaacacauugcuaaccuggccggcucucccgcuaucaagaaaggcauucugcagaccguuaagguggucgaugagcucgugaaaguuaugggacgccauaagccugaaaauaucgugaucgagauggccagagagaaccagacaacgcagaaagggcaaaagaacucccgggaacgcaugaaaagaauugaggaaggaaucaaggagcugggcagccagauucuuaaggagcacccggucgaaaauacccagcugcagaaugagaaacucuaccuguauuaccugcaaaacgggcgggacauguauguggaucaggaacuugacaucaaucgccuguccgauuacgacguggaucauauuguuccccagucuuuccucaaggacgauagcaucgacaacaaaguccugacaagauccgauaagaaucggggaaaaucugacaacgugccuagcgaggaaguggucaagaagaugaaaaauuauuggcgccaacuccugaacgcgaaacuuaucacccagagaaaauuugacaaucugacaaaggccgagcggggcgggcucuccgagcuggauaaagcuggcuucauuaagcgccagcugguggaaaccagacagaucacgaagcacguugcccaaauucuugacagccggaugaacaccaaauacgaugagaacgacaagcugaucagagaagugaaagucauuacacucaagucuaaacugguguccgauuuucgcaaggacuuccaguucuauaagguucgggagaucaauaacuaccaccaugcucacgaugccuaccucaaugccguggucggaaccgcucugauuaaaaaguaucccaaacuugaaagcgaguuuguguacggcgacuauaagguuuacgaugugagaaaaaugaucgcgaagucugagcaggaaaucgggaaggccacagcuaaauauuucuuuuacuccaacauuaugaauuucuuuaagaccgagaucacgcuggccaacggagaaauucgcaaacggccucucaucgagacaaauggcgaaaccggggagauugucugggacaagggaagagauuucgccacagugcgcaaagugcugagcaugccccaggucaacaucguuaagaaaaccgaggugcaaaccggcggguuuucuaaggaaagcauccugccgaagagaaauuccgacaaacuuauugcucggaagaaagauugggacccuaagaaauauggcggauucgacagccccacaguggccuacucuguccuggugguugcgaagguggagaagggcaaauccaagaaacucaagagcgucaaagaacugcucgggaucacgauuauggagcgcuccucuuuugagaagaacccuaucgauuuccuggaagcuaagggauacaaagaggugaagaaagaccuuauuaucaagcugcccaaauauagccuguuugaacucgagaauggccggaagagaaugcuggccuccgccggggaacuucagaagggaaacgagcuggcucucccuucuaaauacguuaauuuccuguaucucgccagccauuacgagaagcugaaaggcucccccgaagauaacgagcagaagcagcuuuucguggaacaacacaaacauuaucuggacgagaucauugaacagaucucugaguuuagcaagcgggucauucuggcggaugcuaaucucgacaaagugcuguccgccuacaacaagcaccgcgauaagccgaucagagagcaggccgaaaacauuauccaccuuuucacccugacaaaucucggggcuccugccgcuuuuaaauauuucgacaccacaauugaucggaagcgcuacaccagcacgaaagagguucuggacgccacacucauccaucaaucuaucaccggccuguacgaaaccagaauugaucuuucccagcugggaggcgacaagcggcccgcggccacaaagaaggcugggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4843 - RNA, 5216 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaacuucaagauucugccgaucgcgauugaccucggaguuaaaaauacaggcguguuuagcgcuuucuaccagaaggggacaucccuggagcggcuugauaacaagaauggaaaaguguaugaacugucuaaggacagcuacacgcuccugaugaacaaucgcaccgccagacggcaucaacgcagaggcaucgaucggaaacagcuugucaagcgccuguuuaaacucauuuggacagagcagcugaaccuggaaugggacaaggauacccagcaagccaucuccuuccucuuuaauagacggggguucucuuuuaucacagacggauauagccccgaguaccugaacauugugccugaacagguuaaggcuauccuuauggauauuuucgacgauuauaauggcgaggacgaucuggacuccuaccucaaacuggccaccgagcaggaaucuaagaucagcgagauuuauaacaaacuuaugcagaagauccuggaauuuaaacucaugaagcugugcacagauauuaaagacgacaagguguccaccaagacgcugaaagagaucaccagcuacgaguucgaacuccuggcugauuaccuugccaauuauucugagucccugaagacacaaaaauuuagcuacaccgacaagcagggcaaccucaaagaacugucuuauuaccaccaugauaaguauaauauccaggaguuccuuaagcgccacgcgacaauuaacgacagaauccuggauacccuccugacggacgaucuggacauuuggaauuuuaacuucgaaaaauucgauuuugacaagaacgaggagaaacuccagaaucaagaagauaaggaccauauccaggcccaucugcaccacuucgucuuugcugugaacaaaauuaaguccgagauggccagcgggggacggcaccgcucucaguacuuccaagaaaucacaaauguucuugacgagaacaaucaucaggaaggcuaucugaagaacuuuugugagaaucuccacaacaaaaaguacuccaaucugagcgugaaaaaccuugucaaucugaucgggaaccucuccaaucuggagcugaagccccucagaaaauacuucaacgauaagauucacgcuaaggccgaccauugggaugaacagaaauuuaccgagacauauugccacuggauccugggagaauggcgggugggcgugaaggaccaggauaaaaaggacggggcgaaauacucuuauaaggaucuuuguaaugagcugaaacaaaaggucaccaaggccggacucguugacuuccugcuggaacuugauccuugccgcaccauucccccuuaccucgacaacaacaauagaaaaccgcccaagugucagagccugauccugaacccuaaauuucucgauaaucaguaucccaacuggcagcaauaccugcaggagcuuaagaaacugcaguccauucagaauuaucucgacagcuucgagacagaucugaaggugcugaagucuuccaaagaccaaccuuacuuuguggaauacaagagcucuaaccagcagaucgcuagcggccagcgggacuauaaagaucuugacgccagaauccuccaauucauuuuugaucgcgucaaggcuuccgacgagcugcugcucaaugaaaucuacuuccaggccaaaaagcugaagcagaaagccucuagcgagcuugagaagcuggaauccagcaaaaagcucgaugaggugauugcuaacucucaacugucccagauccugaaaagccagcauacgaauggcauuuucgaacaggggaccuuucuucaccucguuugcaaguauuacaagcaacggcagagagcgcgcgacucucggcuguauaucaugcccgaguacagauaugauaaaaagcugcauaaauacaacaauacaggacgcuucgacgaugacaaccagcuccugaccuacuguaaucacaagccgcggcagaaaagauaucaacuucugaacgaucucgccggcgugcugcaggucuccccuaauuuucugaaggacaaaauugggagcgaugacgaccuuuucaucuccaaguggcucguggaacacauccgcggauuuaagaaggcuugcgaggauucucugaaaauucagaaagacaaccggggccugcucaaccauaagaucaauauugccagaaacacaaaagggaagugugagaaggaaaucuucaaucugauuugcaaaaucgagggaagcgaagauaagaaaggcaacuacaagcacggccuugccuaugagcuggggguucuccuguuuggagaacccaaugaggcuuccaaaccugaguucgaccgcaagaucaagaaauuuaacucuauuuacagcuucgcccagauccaacagauugcguuugcugaacggaagggcaaugccaacaccugugccgugugcuccgcugauaaugcccauagaaugcagcaaaucaaaauuacggagcccgucgaagacaacaaggauaaaaucauccugagcgcuaaggcccagcggcuucccgcgauuccuacacgcaucguggacggggccgucaagaaaauggcuaccauucuggccaagaauaucguggaugacaacuggcagaauauuaaacagguucucucugcuaagcaccaacugcacaucccgaucauuaccgaguccaacgccuucgaauuugagcccgcgcucgccgaugugaaaggaaagagccugaaggacagacggaaaaaggcucuugagagaaucucuccugaaaauauuuucaaagacaagaacaaccgcaucaaagaguucgccaagggcauuuccgcuuauagcggggccaaucugacagauggcgacuuugauggagccaaagaggaacucgaccauaucauuccccggucucacaagaaguacggcacccugaacgaugaggcuaaucugaucugcgucacaagaggggacaacaaaaauaagggaaaccgcaucuucugucuuagagaucuggcggacaauuauaaacucaagcaguuugaaacgaccgaugaccuggagauugagaaaaagaucgccgauacaauuugggacgcuaacaagaaagauuucaaguuuggcaauuaccggagcuucaucaaccucaccccucaggaacagaaagccuuucgccaugcccuguuccuugcugacgaaaaucccauuaagcaagccgugaucagagcgaucaacaaucggaaccgcacauuuguuaaugggacccagagauacuucgcugaggugcuggccaacaauauuuaucuccgggccaaaaaggagaaccugaacacggacaagaucuccuuugauuacuucggcauuccgaccaucggaaaugggcgcggcauugcugaaaucagacagcuguaugagaaagucgacagcgauauccaggccuacgcgaagggagacaaaccucaggcuucuuauucccaccuuauugaugccaugcuggccuucugcaucgcugccgacgaacaucggaacgauggcagcauugggcucgagaucgacaagaauuacucccuguauccccucgauaaaaacacaggagaaguguuuaccaaggacauuuucucucaaaucaagauuacagauaaugaguuuagcgacaaaaagcuggugcgcaaaaaggcuaucgagggcuucaacacccacagacagaugacgcgggaugggaucuacgccgaaaauuaccuuccuauucugauccacaaagagcugaacgaaguuagaaagggauauacauggaaaaauuccgaggaaauuaagaucuuuaagggcaaaaaguacgacauucagcaacucaacaaucuggucuauugucuuaaauucguggacaagcccaucucuaucgauauucagaucagcacccuggaggagcuccgcaacauucugacaaccaauaacaucgcggccaccgcugaauacuauuacauuaaucucaaaacacagaagcugcaugaguauuacaucgaaaacuacaacacggcccuuggguauaagaaauacuccaaggagauggaguuucugcggucucuggcuuauagaagcgaacgcgugaaaaucaaguccauugacgaugucaaacaagugcucgacaaggauagcaauuucaucauuggcaagaucacccugccuuuuaaaaaggaguggcagcggcuuuacagagaauggcagaacacaaccauuaaagacgauuaugaguuccugaagucuuucuucaauguuaaauccaucacaaagcuccacaagaaagugcgcaaggacuuuagccugcccauuucuaccaacgaaggaaaauuccucgucaagcggaaaacgugggauaauaacuucaucuaccagauccugaaugacuccgauagcagagccgacggcacaaagccguuuauuccugccuucgacaucucuaaaaacgagauuguggaggcuaucauugauuccuuuaccagcaagaauaucuucuggcuucccaagaacaucgaacugcaaaaaguugacaauaagaacauuuuugcgaucgauaccuccaaaugguucgagguggaaacacccagcgaccugcgcgauauugggaucgccaccauucaguauaagaucgacaauaacucucggccuaaagucagagugaagcucgauuacguuaucgacgaugacagcaagauuaauuacuuuaugaaccauucccugcuuaaaucucgguauccggauaaggugcuggagauccucaaacagagcacaauuaucgaauuugaguccucuggauuuaacaagacgauuaaagagaugcugggcaugaagcucgcugggaucuacaaugaaaccagcaacaauaagcgccccgccgccaccaaaaaggcuggacaggccaaaaagaaaaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4844 - RNA, 3488 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagcggaacuacauucugggacucgacaucggcauuaccagcguuggguauggaaucauugauuacgagacacgcgacgugaucgaugcgggcgugagacuguucaaagaagcuaaugucgagaacaaugaagggcggcgcuccaagagaggagcccggcgccuuaagagacggcgcagacaucggauccagcgcgugaaaaagcugcucuuugacuauaaccugcuuacggaucacucugagcugagcggcauuaauccguacgaagccagaguuaaaggccucucccaaaagcugucugaggaggaguucagcgcugcccugcuccaucuggcuaaacggcgcggggugcacaacgucaaugaaguggaagaggacaccggaaacgagcuuuccacaaaggaacagaucucuagaaauagcaaggcccuggaggaaaaauauguugcggagcuccagcuggaacggcuuaagaaagauggcgaggugagaggguccauuaaccgcuuuaagaccagcgacuacgucaaagaggccaagcagcugcucaaagugcaaaaggcuuaucaucagcuggaucagucuuucaucgacacauacauugaucugcucgaaacccggagaacauacuaugagggacccggcgaaggguccccuuuuggauggaaggacaucaaagagugguacgaaaugcugaugggccacugcaccuauuuccccgaggagcuucgcagcgugaaguacgccuauaaugcugaucuguacaacgcccucaaugaccugaacaaucuugucauuacgcgggacgaaaacgagaaacuggaauauuacgagaaguuucagaucaucgaaaacguuuucaaacaaaagaagaaaccuacccucaagcagauugcgaaagagauccuggugaaugaggaagauauuaagggcuacagagugacaucuaccgggaaacccgaguuuacaaaccugaaggucuaucacgacaucaaggauauuaccgcccgcaaagaaaucaucgagaaugcugagcuccuggaccagauugccaagauccuuacgauuuaccaguccagcgaagauauccaagaggaacugacaaaccucaauucugagcugacccaggaagagauugagcagaucuccaaccuuaaaggauauacaggcacccauaaucugagccucaaggcuaucaaccugauucuggacgaacucuggcacaccaaugauaaccaaaucgccauuuucaaucggcugaaacuugugccuaagaagguugaccugucccagcagaaagagaucccgacaacgcucguggaugacuuuauucugucucccgucgugaagcgcagcuucauccaguccauuaaaguuaucaacgccaucauuaagaaauacgggcugccuaaugauaucauuaucgaacuugcucgcgagaagaacagcaaagacgcgcaaaagaugauuaaugaaaugcagaagcggaacagacagaccaacgagcgcaucgaggaaaucauucggacaaccggaaaagagaaugccaaguaucucaucgagaaaauuaagcugcaugacaugcaggaaggcaaaugucuguacucucucgaagcuaucccccuggaggaucuucugaacaauccuuuuaacuaugagguggaccacauuauccccagauccgucagcuucgauaauucuuucaacaauaaggugcucgucaagcaagaagagaacagcaaaaaggggaaucggacaccguuucaguaccuguccucuagcgacuccaaaaucagcuacgaaaccuucaagaaacacauucugaaccuugccaagggaaagggccgcaucucuaaaacgaagaaagaguaucuccuggaggaaagagauauuaaucgguuuuccgugcagaaggacuucaucaacagaaaucugguugauacacgcuacgccacccggggccucaugaaccugcuuagaagcuauuuucgcgugaauaaccuggacgucaaagugaagucuauuaacgggggauucaccuccuuucucagacggaaguggaaauucaagaaagagcgcaauaagggcuacaaacaucacgcugaagaugcccugaucaucgcgaacgcugacuuuauuuucaaggaguggaaaaagcuggauaaggccaaaaagguuauggaaaaucagauguuugaggagaaacaagccgaaagcaugccugagaucgaaacagagcaggaauauaaggagauuuucaucacaccccaucagauuaaacacaucaaggacuuuaaggauuacaaauauucccauagaguggacaagaaaccuaaccgggagcuuauuaaugacacccucuacucuacgcgcaaggaugacaaagggaacacccugaucgucaauaaccugaauggacucuacgauaaggacaacgauaagcugaagaaacuuaucaauaaaagccccgaaaagcugcucauguaucaccacgacccccagacauaccaaaaacugaagcugauuauggagcaguauggcgaugaaaagaacccucuuuacaaauauuacgaggaaaccgggaauuaucucacaaaguacuccaaaaaggacaacggcccggugaucaaaaagauuaaguacuauggaaauaaacugaacgcucaucuggauaucaccgacgauuaccccaacucuagaaauaaggugguuaaacucagccugaagccuuaucgguucgacgucuaccuugauaacggcguguauaaauucgugacggucaagaaucuggacgugauuaaaaaggagaacuacuaugagguuaauuccaagugcuacgaagaggccaaaaagcucaaaaagaucagcaaccaggcugaauuuaucgccucuuucuacaauaacgaccugauuaaaaucaauggggagcuguaucgcgugauuggagucaacaaugaucuucugaacagaaucgaggugaauaugauugacaucaccuaccgggaauaucucgagaacaugaaugauaagagacccccuagaaucauuaagacaaucgcguccaaaacccaaagcauuaagaaauacucuacagacauccugggcaaccucuaugaaguuaaguccaaaaagcacccccagauuaucaagaaagggaagcggccggccgcuaccaaaaaggccggacaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4845 - RNA, 4556 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccuguucaacaagugcauuaucauuagcaucaaucucgacuuuuccaacaaagagaaguguaugaccaagccguacucuauuggacuggauaucggcacaaauagcguugggugggcggugaucacggacaacuauaaagugcccuccaagaaaaugaagguccuuggaaauaccucuaaaaaguacauuaagaaaaaccugcucggcgugcugcuuuucgauagcgggaucacagcugaaggacggcgccugaagagaaccgcccggcgcagauauacacggcgcagaaaucggauucucuaccugcaggagaucuuuuccaccgaaauggccacacuggacgaugcuuucuuucaacgccucgacgauucuuuccugguuccugacgauaaaagagacagcaaguaucccauuuuuggcaaccuuguggaggaaaaagucuaccaugaugaguucccuaccaucuaucaucugcggaaguaccucgccgacuccacgaaaaaggcugaucugcgccuuguguaccuggcccucgcgcacaugauuaaguauagaggccacuuucugaucgagggggaguucaauagcaaaaacaaugacauccagaagaacuuucaggacuuccuggauaccuacaaugccauuuuugaaucugaccucucccuggaaaacagcaaacagcuugaggagaucguuaaggauaaaauuucuaagcuggaaaagaaagaccggauccucaagcuguuccccggagagaaaaauuccggcauuuucagcgaauuucuuaagcugaucguggggaaccaagcugauuuccgcaaaugcuuuaaccucgacgagaaggccucucugcauuucuccaaggaaagcuaugaugaggaccuggagacacuccugggauacaucggcgaugacuauuccgaugucuuucuuaaagcuaagaaacuguacgacgccauucuccugucuggguuccuuaccgugacagacaaugaaaccgaggcgccucugagcuccgccaugaucaagagauauaacgaacacaaagaggaucucgcucugcugaaggaauacauucggaauaucagccucaagacguacaacgagguguuuaaagacgauacaaagaauggauaugccggcuacauugacggcaaaaccaaccaggaggauuucuaugucuaccugaagaaucuucuggcugaauuugagggggccgacuauuuccucgaaaagaucgauagagaggacuuucugcgcaagcagcggacauucgauaacggaucuaucccguaccagauucaucugcaagaaaugagagccauccuugacaaacaggcuaaguuuuaucccuuccucgcgaagaauaaagagcgcauugagaagauccugaccuuccggauuccuuacuacguuggcccccuggccagagggaacuccgauuuugcuuggagcauccgcaaacggaaugaaaagauuaccccuuggaacuucgaggacgugaucgauaaagaaucuagcgccgaggccuuuaucaauagaaugacauccuucgaccucuaucugcccgaggaaaaggugcuuccgaagcacucucugcucuacgagacguuuaacgucuauaaugaacugaccaaagugcgcuucauugcugagagcaugcgggacuaccaguuucuggauuccaagcagaaaaaggacaucguuagacuuuauuucaaagauaagcgcaaggugacagacaaagauauuaucgaauaccuccacgccauuuauggauacgacggcaucgagcugaaggggaucgagaaacaauuuaacagcucucuguccaccuaccaugaucuccugaacauuaucaaugacaaggaguuccuugaugacagcucuaacgaagcgauuaucgaagagauuauccacacacugaccaucuuugaagaucgggagaugauuaaacagagacucuccaaguucgagaauaucuuugacaagagcguccugaaaaagcugucccggcgccacuauacgggauggggcaaacuuucugcuaagcucauuaacggcaucagagaugaaaagagcgggaauacaauucuggacuaccugaucgacgauggaaucuccaaccggaauuucaugcagcucauucaugacgaugcccugucuuucaagaaaaagauccaaaaggcccagauuaucggcgacgaggauaaagggaacauuaaggaagugguuaaaagccuuccuggaucccccgcuaucaagaaaggcauucugcagagcaucaagaucguggacgagcucgucaaggugaugggcgggagaaaaccugaaucuauugucguggagauggcccgcgagaaucaguauaccaaccaaggaaaguccaauagccagcagcggcugaaaagacuggaaaagucucuuaaagagcucggcuccaagauccugaaggaaaacauucccgcuaaacugagcaagaucgauaauaacgcccuccagaaugaccgccuguaccuuuauuaccugcaaaacgggaaagauauguauaccggagacgaucucgacauugacagacugucuaacuacgauaucgaccacaucauuccccaggcguuucugaaggauaauagcaucgacaacaaaguucuuguguccagcgccucuaaucggggcaaguccgaugacuucccuagccuggaggucgugaagaaacgcaagacauuuugguaccagcuccugaaauccaagcucauuucucagagaaaauucgauaaccugaccaaggcugagcgcgggggacuucugccggaagacaaggccggcuuuauccaacggcagcucguugagacaagacagauuacgaaacauguggcucggcugcuggaugaaaaguucaauaacaaaaaggacgagaauaaccgcgccgucagaaccgugaaaaucaucacacuuaagagcacccuggugucccaguuucggaaagauuucgaacucuauaagguucgcgagauuaaugacuuucaccaugcgcacgaugccuaccugaacgcugucaucgccucugcucuccugaagaaauaucccaaacuugagccugaguucguguacggggacuaucccaaauacaauagcuuuagagaacggaaguccgccacagaaaaaguguauuucuacucuaacauuaugaauaucuucaaaaagagcauuucccuggccgacggcagagucaucgagcgcccucucauugaagugaacgaggagaccggagaaagcguuuggaauaaagagucugaucuggcuacggugcggagaguccuguccuacccccaagugaacguugugaagaaagucgaggaacagaaccacggccuugaccgcgggaagccgaaaggacuguuuaaugcgaaccucagcucuaagccuaagcccaauuccaacgaaaaucuggugggcgccaaagaguaucucgauccuaagaaauacgggggauaugcuggcaucagcaacucuuucgccguucuggugaaggggaccaucgagaaaggcgccaagaagaaaauuacaaauguccuugaauuucagggaaucuccauucuggaccggaucaacuacagaaaggauaaacugaauuuccuccuggagaagggcuauaaagacauugaacuuaucaucgagcugcccaaguacagccucuuugagcuguccgaugggagccgccggaugcucgcuucuauucugagcaccaacaauaaaagaggagaaauccauaagggcaaccaaauuuuccuuucccagaaguuugugaaacugcuguaucacgccaagcgcaucucuaauacaauuaacgagaaucaucggaaauacguggaaaaccacaagaaagaguucgaggaacucuuuuacuauauccuggaguucaaugaaaacuacgucggggcgaagaagaacggaaaacuucugaauagcgcuuuucaguccuggcagaaccacucuaucgacgagcucuguagcuccuucauuggcccuaccgggucugaaagaaagggccuguuugagcucacgagccggggauccgccgccgauuucgaguuccugggcguuaaaaucccccgcuauagagacuacacaccgagcucucuucugaaggaugcuacccugauucaucaauccgugacagggcucuaugaaacccggaucgaccuggccaaacuuggagagggcaagcgcccugcggcuaccaagaaagccgggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4846 - RNA, 3632 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccugguacgcgagccugauguccgcucaucaccuccggguuggaauugacgugggcacccauucuguggggcuggccacacuucgcgucgaugaccacggaacgccgaucgagcugcucagcgcccugucccauauucacgauucuggcguggggaaggaagggaaaaaggaccacgauaccagaaagaaacuuagcggcaucgcucggcgcgccagacggcugcuccaucaccgcagaacacagcugcaacagcuggacgagguucuccgggaucugggcuuccccauuccuacccccggggaauuucuugaccugaacgagcagacagauccuuaucgcguguggagaguccgggcucgccucguggaagagaagcugcccgaggaacuuagaggaccugccaucuccauggcgguucggcauaucgcccgccacagaggcuggcggaauccguacucuaaaguggagagccugcucucccccgcugaagagagcccuuucaugaaggcccugagagagcgcauucuggcuaccacaggggaaguccucgacgauggaaucacccccggccaggccauggcgcaaguggcccugacgcacaacauuucuaugcgggggccugagggaauccuuggcaaacugcaucaguccgacaaugcuaacgaaauuagaaagaucugcgcccgccagggcgugagccccgaugucuguaagcagcuccugcgggcuguuuuuaaagccgacucuccgagaggguccgccgugagccgcguggcuccugacccccuuccuggacaaggcucuuuccggagagcgcccaagugcgaucccgaguuucagcgcuuccggauuaucuccaucgucgccaaucugagaauuagcgaaaccaaaggggagaaccgcccucucacagcugacgagcggagacacgugguuaccuuucugacagaagauucccaggccgaccugaccuggguggaugucgccgagaagcucggagugcaucggcgcgaccugagaggcacggcuguucacacagaugacggggaacggucugccgcgagaccgcccaucgaugcuaccgaccgcauuaugcggcagacaaaaaucagcucccuuaagaccuggugggaggaagccgauagcgagcaaagaggagccaugauucgcuaucuguacgaggacccuaccgacucugaaugugcugagaucaucgccgaacuccccgaggaagaucaggcuaaacuggacucccuucaucugccugccggcagagcggccuauagccgggagucucucacagcucugagcgaucacaugcuggccacgaccgacgaucuccacgaggcucgcaagagacuguucggcguggacgauuccugggcgcccccggccgaagccauuaaugcuccugucgggaaccccucuguggaccggacacuuaagaucgucggacgcuaccugagcgccguggaguccauguggggcaccccugaaguuauucauguggagcacgucagagauggguuuacaagcgagcggauggcugacgaacgcgauaaagccaauagacggcgcuauaacgacaaucaggaggccaugaagaaaauccaaagagauuacggaaaggaaggcuacauuucucggggagacaucgugagacucgacgcucuggagcugcagggcugcgcgugucuuuauugcggaaccacgaucggcuaccauacaugucagcucgaucacauuguuccccaggccgggccuggauccaacaaucgccggggcaaccugguggcugucugcgaaagauguaaucgcagcaaaucuaacacccccuucgccgugugggcccaaaagugcgggaucccgcacgugggaguuaaggaggcuauuggccgggucagaggguggcgcaaacagaccccuaacacauccagcgaggaccugacccggcucaagaaagaagugaucgccagacugcgccggacacaggaggaucccgaaauugacgagagauccauggaaucuguggcguggauggcuaaugagcuucaucaccggaucgccgccgcuuaucccgagacgaccgucaugguguaccgcggcagcauuacagccgcggcuagaaaggccgccggaaucgauucccggaucaaccugauuggcgaaaaagggcgcaaggacagaaucgaucggagacaucacgcuguugacgccucuguggucgcucucauggaggccagcguggcgaagacccuggccgaacgcuccagccugcggggagagcagagacuuacaggcaaagaacaaaccuggaagcaguauacggggucuaccguuggagcucgcgagcauuuugagauguggcggggccacaugcuccaccugacagaacuguucaaugagagacucgccgaagauaaaguguacgucacccagaacauucgccugcggcuuuccgacgggaaugcucauacagugaacccuagcaagcugguuucucacagacucggcgauggacugaccgugcagcaaaucgaccgcgccuguacgccggcccuguggugcgcucuuacaagagagaaagauuuugacgagaagaauggccuccccgcgcgggaagaccgcgccauuagaguccaugggcacgagaucaaguccagcgauuauauccagguguucucuaaacggaagaaaaccgacagcgaucgcgacgaaacaccuuucggagcuauugccgugagaggcggguuugucgagaucggacccuccauucaucacgcccggaucuacagaguugaaggcaagaaaccuguguacgcuaugcugcgcguguucacccacgaucugcucagccagcggcauggggaccuguuuucugccgucauucccccucaguccaucagcaugagaugcgcggagcccaaacuucgcaaagcuaucaccacaggcaacgccacguaucugggaugggugguugugggcgaugagcucgaaauuaaugucgacuccuucaccaaguacgccaucgggcgguuucuggaggauuucccgaacacaaccagauggcggauuuguggauaugacacaaauucuaagcugacccuuaaaccuaucgugcucgcugccgaaggccuggagaaccccagcuccgcgguuaaugaaauuguggagcugaagggguggcgcgucgcuaucaacgugcucacgaaaguucacccuacaguggucagacgggaugcccugggacgccccagauacucuagccgguccaaucuuccgaccucuuggaccaucgagaagcgcccugccgcuacaaagaaggccggccaagcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4847 - RNA, 4493 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaccaagccguacagcauuggacuggacaucggcacaaacuccguugggugggcggugacgaccgauaauuauaaagugcccucuaagaagaugaaaguccucggaaacacaagcaagaaauacauuaagaaaaaucugcuuggcgugcuccuguucgacuccgggaucaccgcugagggacggcgccugaagagaacagcccggcgcagauauacccggcgcagaaaccggauucuuuaccugcaggaaaucuuuucuacagagauggccacccucgaugacgcuuucuuucaacgccuggaugacagcuuccugguuccugaugacaagagagauuccaaauaucccaucuuuggcaaucucguggaagagaaggccuaccaugacgaguucccuacgauuuaucaucugcggaaauaccuugcugauucuaccaagaaagccgaccugcgccucgucuaccuggcgcuugcccacaugaucaaguauagaggccacuuucugauugagggggaguucaacagcaaaaauaacgauauccagaagaauuuucaggacuuccucgacacauacaacgcuauuuuugaauccgaucugagccuggaaaauucuaagcagcucgaagagaucgugaaagacaagauuuccaaacuggagaagaaagaucggauccuuaagcuguuccccggagaaaagaacagcggcaucuuuucugaguuccucaaacugauuguugggaaucaagccgacuuccgcaagugcuuuaaccuugaugaaaaggcuucccugcauuucagcaaagagucuuaugacgaagaucucgagacccugcugggauacaucggcgacgauuauuccgacguguuucucaaagccaagaagcuguacgaugcgauucuucugagcggguuccucacagucaccgacaaugagacggaagccccucuguccucugcuaugaucaaaagauauaacgagcacaaggaagaccuugcccugcucaaagaguacauucggaacaucagccugaagacauacaaugaaguguuuaaagaugacaccaagaacggauaugcuggcuacaucgauggcaagacaaaucaggaggacuucuauguguaccugaaaaagcuccuggccgaguuugaaggggccgauuauuuccuugagaaaauugacagagaagauuuucugcgcaagcagcggaccuucgacaacggauccaucccguaccagauucaccuccaagagaugagagcuauccuggauaaacaggcgaaguuuuaucccuuccuggccaaaaauaaggaacgcauugagaagauccuuaccuuucggaucccuuacuacgucggcccccucgcuagagggaacagcgacuucgccuggucuauucgcaaacggaaugagaagaucacaccuuggaacuucgaagauguuauugacaaagaguccagcgccgaggcuuuuaucaauagaaugacgucuuucgaucuguaucugcccgaagagaaggugcucccgaaacauagccugcuuuacgaaaccuuuaacguguauaaugagcugacaaagguccgcuucauugccgaauccaugcgggacuaccaguuucucgacucuaagcagaaaaaggauaucgugagacuguauuucaaagacaagcgcaaaguuaccgauaaggacauuaucgaguaccugcacgcgaucuauggauacgauggcauugaacuuaaggggaucgagaaacaauuuaacagcucccucagcacauaccaugaccugcugaauauuaucaacgauaaggaguuccucgacgauucuuccaaugaagcuauuaucgaggaaaucauucacacccugacgaucuuugaggaccgggaaaugauuaaacagagacuuagcaaguucgagaacaucuuugauaaaucugugcugaagaagcucucccggcgccacuauacaggauggggcaaacugagcgccaagcugauuaacggcaucagagacgagaaauccgggaauaccauccuugauuaccucauugacgacggaaucucuaaccggaauuucaugcagcugauucaugaugacgcccugagcuuuaagaaaaagauccaaaaagcucagauuaucggcgaugaagacaaggggaacaucaaggaggucgugaaaucccucccuggaucucccgccauuaagaaaggcauccugcagagcauuaagaucguugaugaacuugugaaagucaugggcgggagaaagccugaguccauuguggucgaaauggcucgcgagaaucaguauaccaaccaaggaaagagcaauucucagcagcggcugaaaagacucgagaagucccugaaagaacugggcagcaagauccuuaaagagaacauucccgccaagcucucuaagaucgacaauaacgcgcugcagaaugaucgccuguaccucuauuaccugcaaaacgggaaagacauguauacaggagaugaccuugauaucgacagacuguccaauuacgacauugaucacaucauuccccaggccuuccucaaggacaacagcaucgauaauaaagugcugguuucuagcgcuuccaaccggggcaagagcgacgaugugccuucucuggaagucgugaaaaagcgcaagaccuucugguaccagcuucugaaauccaagcucauuagccagagaaaauuugacaaccugacaaaggccgagcgcgggggacucuccccggaggauaaagcuggcuucauccaacggcagcugguugaaacgagacagaucaccaagcauguggcccggcuucuggacgagaaguuuaauaacaaaaaggaugaaaauaaccgcgcggucagaacagugaaaauuaucacccucaagucuacacuggugagccaguuccggaaagacuuugagcuguauaagguucgcgaaauuaaugauuuccaccaugcccacgacgcuuaccuuaacgccgucguggcuuccgcccugcucaaaaaguaucccaagcuggagccugaguuuguguacggggauuaucccaaauacaauucuuucagagaaagaaagagcgccaccgagaaagucuauuuuuacuccaacaucaugaauauuuucaagaaaucuaucagccucgcugacggccgggugaucgaacgcccucugauugagguuaacgaagagacgggagaguccguguggaauaaggaaagcgaccuugcgaccguccggagagugcugucuuacccccaaguuaacguggucaagaaaguggaggaacagaaucacggccucgaucgcgggaagccgaaaggacuguuuaacgccaaucuguccagcaagccuaaacccaacucuaacgagaaucuuguuggcgcuaaggaauaucuggacccuaagaaauacgggggauaugccggcaucuccaacagcuucacagugcucgucaaggggaccauugagaaaggcgccaagaaaaagaucacaaaugugcuggaguuccagggaauuucuauccucgaucggauuaacuacagaaaggacaaacugaauuuucuucuggaaaagggcuauaaagauaucgagcugaucauugaacuccccaaguacucccuguucgagcuuagcgacgggucccgccggaugcuggcuagcauccucucuaccaacaauaaaagaggagagauucauaagggcaaccaaaucuuucugagccagaaauucgugaagcuccuguaucacgccaagcgcauuuccaauacgaucaacgaaaaucaucggaaauacgucgagaaccacaagaaagaauuugaggaacuuuucuacuauauccuggaguuuaaugagaacuacguuggggcgaagaaaaauggaaagcugcucaacucugcuuuccagagcuggcagaaucacuccauugaugaacuguguucuagcuuuaucggcccuacaggguccgagagaaagggccuuuucgaacugaccucucggggaagcgccgccgacuuugaguuccucggcgugaaaauuccccgcuauagagauuacacaccguccagccugcucaaggacgcuacccugauccaucaaucugugaccgggcuuuaugaaacacggauugaucuggccaaacugggagagggcaagcgcccugcggcuacgaaaaaggccgggcaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4848 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaacagcauuaauuacauccugggacucgacauuggcaucgccuccguugggugggccaugguggagauugaugaagaggaaaaccccauccggcugaucgaccuuggagugcgcgucuuugagagagcugaagugccuaaaaccggcgauucucuggccauggcucggcgccucgccagaagcguucggcgccugacaagacggcgcgcgcauagacuucugcggacgcgcagacuccugaagcgggagggggugcugcaggccgcuaauuucgacgagaacggacucauuaagucccugcccaauaccccuuggcaacuucgcgccgcugcccuggauagaaaacucacaccccuggaauggucugcgguccuucugcaccucaucaagcaucggggcuaucugagccagcgcaaaaacgagggcgaaaccgccgacaaggagcugggggcucuccugaaaggaguggccggcaaugcucacgcccuucagacaggggauuuuagaaccccugccgagcuggcucucaacaaguucgaaaaggaguccggacauauucggaaucagagaucugacuacagccacacauuuucccgcaaagaucugcaagcggaacuuauccuccuguucgagaagcagaaagaauuuggcaacccgcacguuagcgggggacugaaggagggcauugagacccugcucaugacgcagcggcccgcccugucuggcgacgcugugcagaaaaugcuugggcauugcaccuucgaaccugccgagcccaaggccgcuaaaaauacauauaccgccgaaagauuuaucuggcugacaaagcucaacaaucugcgcauucuugagcaaggauccgaacggccucugaccgauacggagagagcgacacucauggacgagcccuaccgcaagagcaaacugaccuaugcucaggcccggaagcugcucggccuggaagauacagccuucuuuaaagggcuuagauacggaaaggacaacgcugaggccucuacccugauggaaaugaaggcuuaucacgccaucucccgcgcgcucgagaaggaaggccugaaggacaaaaagagcccgcugaaucuuucuccugagcuccaggaugagaucgggaccgccuucucccuguuuaaaacagacgaagauauuacgggacggcugaaggacagaauccagcccgagauucucgaagcucugcuuaaacauaucagcuucgauaaguucguccaaauuucccugaaggcccuccggcgcaucgugccucugauggagcagggcaaaagauacgacgaggcuugugccgaaaucuacggcgaucacuaugggaagaaaaacaccgaggaaaagauuuaccugccucccauccccgcggacgagauucggaacccggugguccuuagagcccucucucaggcucgcaaaguuaucaauggaguggugcggagauauggcagccccgcccgcauucacaucgaaacagcuagagaggucgggaaguccuuuaaggaucggaaagagaucgaaaagcgccaagaggaaaacagaaaagaccgggagaaggccgccgcuaaauuccgcgaauacuuuccuaauuucgugggagagcccaagagcaaagauauucugaagcugagacucuaugagcagcagcauggcaagugccuguacucugggaaagaaaucaaccuuggccggcugaaugagaagggauauguugaaauugaccacgcgcucccuuuuucccgcaccugggacgauagcuucaacaauaaagugcugguccugggcucugagaaccagaauaaggggaaccaaacacccuacgaauacuuuaauggaaaagacaacagcagagaguggcaggaguucaaggcccggguggaaaccucccgcuuuccgagaucuaagaaacagcggauccuucuccagaaguucgaugaggacggcuuuaaagaaagaaaucugaacgauacgcgcuauguuaaucgguuccugugucaauuuguggcugacagaaugcgccucacagggaagggcaaaaagcgggucuucgccagcaacggacagauuaccaaccugcuuagaggguucuggggccugcgcaaggugcgggccgagaaugauagacaucacgcucucgacgccgucgugguugcgugcuccaccguggcuaugcagcagaaaaucacacgcuuuguccgguacaaggagaugaacgccuucgauggaaaaaccauugacaaggaaacaggcgaggugcugcaucagaaaacgcacuuuccucagcccugggaguucuuugcccaggaaguuaugaucagaguguucgggaagccugauggaaagcccgaauuugaggaggcugacacccuggaaaaacuucggacacuccuggccgagaagcugagcucucgcccugaagcgguccacgaguaugugacaccccucuucguguccagagcuccgaaucggaaaaugagcggccaggggcauauggaaaccguuaagucugccaaacgccuggaugagggagucuccgugcuuagagugccucugacccaacucaagcugaaagaccuggagaagauggucaaccgggaaagagagcccaaacuuuacgaagcccugaaagcucgccucgaggcccacaaggacgaucccgcuaaagccuuugcggaaccuuucuauaaguacgacaaagccggcaaucggacgcaacaggugaaggcuguuagaguggagcaaguccagaagaccgggguguggguucgcaaccauaauggcaucgccgauaacgcuacaauggugcgggucgacguguuugagaaaggagauaaguauuaccugguuccgauuuacagcuggcaaguggccaaaggcauccuccccgacagagccgucgugcaggggaaggaugaagaggacuggcagcugauugaugacuccuucaauuuuaaauucucucuucacccuaacgaucugguggaagucaucaccaagaaggcucgcauguucggauauuuugcgagcugucaccggggcacagggaauauuaacaucagaauccaugaccucgaucacaaaauuggaaagaauggcauccuggaggggauuggcguuaaaaccgcccuguccuuccagaaguaccagaucgacgagcuuggaaaagaaauucgccccugcagacugaagaagcggccucccgugcgcaaaagaccugcugccacgaagaaagccggccaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4849 - RNA, 4331 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacaccauuggacuggacaucggcacaaacagcguugggugggcggugcucacggaucaguaugaccuggugaagcggaagaugaaaauugcuggagauuccgagaagaaacaaaucaagaaaaauuucuggggcguccgccuuuuugacgaagggcagaccgccgccgauagacggauggcucgcacagccagacggcgcauugagagacggcgcaacagaaucucuuaccugcagggaaucuucgcugaagagaugagcaagaccgacgccaauuucuucugccggcucuccgauucuuuuuauguggacaacgaaaagcgcaauagcagacaucccuucuuugcgacaauugaggaggaaguugaguaccacaaaaacuauccuaccaucuaccaucugcgggaggaacuugucaauuccucugagaaggccgaucugcgccucgucuaucuggcucuggcccacauuaucaaauacagaggcaacuuccucauugaaggcgcucuggacacacagaauaccagcguggaugggaucuacaagcaauuuauucagacguauaaccagguuuucgccuccggaaucgaggacggcagccuuaaaaagcuggaagauaauaaagacguggcgaagauccucgucgagaaggugacccggaaagaaaagcuggagcgcauucuuaaacuguaccccggggagaagucugccggaauguuugcucaguucaucucccucauugugggcagcaaagggaacuuucaaaagccuuucgaccugaucgaaaagucugauauugagugugccaaagacuccuaugaagaggaucuggaaagccuccuggcucuuaucggagacgaguacgccgagcuguucgucgccgcuaagaaugcguauucugccguugugcucuccagcaucauuacaguggcugaaaccgagacaaacgccaaacuguccgccucuaugaucgaaagauuugauacccaugaggaagaccuuggcgagcugaaggcuuucauuaaacuccaucugcccaagcacuacgaggaaaucuuuagcaauacggagaagcacggcuaugccggguacauugauggaaaaacaaagcaggcggacuucuacaaauauaugaagaugacccuggaaaacaucgagggcgcugauuacuuuaucgccaaaauugagaaggaaaacuuccuccggaagcagagaacauuugacaauggggccaucccucaccagcugcaucuugaggaacuggaggcuauucuccaccaacaggccaaauauuacccguuccugaaggaaaacuaugauaaaaucaagucccuugucaccuuucgcauucccuacuucgugggaccucuggcuaauggccagagcgaguuugccuggcucacccggaaagcggacggggagaucagacccuggaacauugaagagaagguugacuucggaaaaucugccguggauuuuaucgaaaagaugacaaauaaggacacguaucugccuaaagagaacguccugcccaagcacucccucugcuaccaaaaauaccugguguauaaugaacuuaccaagguucgcuacaucaacgaucagggcaaaacaagcuauuucucuggccaggagaaggagcagauuuucaaugaccuguuuaagcaaaaacggaaggugaaaaagaaagaucucgaacuguuccugagaaacaugagccaugucgaguccccgaccaucgaagggcuugaggacucuuuuaauagcuccuacagcacauaucacgaucuccugaaggugggaauuaagcaggaaauccuggacaacccugucaauaccgagaugcucgagaacauugugaaaauccugacgguuuucgaagauaagcgcaugaucaaagagcagcuucagcaauuuucugacgugcuggauggcgucgugcucaagaaacuggaacggagacauuacacaggguggggacgccuguccgcuaagcuccucaugggcauucgggacaagcagagccaccugaccauccuggauuaucucaugaaugacgacgggcugaacagaaaccuuaugcagcugauuaaugauucuaaccucuccuucaaaagcaucauugagaaggagcagguuaccacagccgacaaagauauccaauccaucguggcugaccuggccggcucucccgcgauuaagaaaggaauccugcagagccuuaagauugucgaugaacucguguccgugaugggcuacccuccccagaccaucguugucgagauggcccgggaaaaucagacaacggggaaaggaaagaacaauucucgccccagauacaagagccuggagaaagcuauuaaggaauuuggcucccaaauccugaaagagcauccuaccgacaaccaggagcuccggaauaacagacuguaucuuuacuaucugcagaaugggaaggauauguacacaggacaagaccucgauauccacaaccugagcaauuaugacauugaucacaucgugccgcagucuuucauuaccgacaacuccaucgauaaucuggugcuuacaagcucugccggcaaccgcgaaaaaggggacgacgugcccccucucgagauugugcggaagagaaagguguuuugggaaaaacuguaccagggcaaucugauguccaagcgcaaauucgauuaucucaccaaggcugagagaggaggccugacggaagccgacaaagcccgguuuauccaucgccagcuuguugagaccagacaaauuacaaagaacgucgcuaacauccugcaccagcgguucaauuacgagaaggaugaccaugggaacaccaugaaacaggugcgcaucguuacacucaagagcgcgcuggugucucaguuuagaaaacaauuccagcuguacaagguccgggaugugaaugacuaucaccacgcccaugaugcuuaccuuaacggaguuguggccaauacccugcucaaagucuauccccagcuggaaccugaguucguguacggcgacuaucaccaguuugauugguucaaggccaacaaggcuacggccaaaaagcaauuuuacacaaauauuaugcuuuucuuugcgcagaaagaccgcaucauugaugaaaacggggagauccugugggacaagaaauaucuugacaccgugaagaaggucaugagcuacagacagaugaauauuguuaaaaagacagaaauccaaaaaggagaguucuccaaggcuaccaucaaacccaagggcaacagcucuaaacugauuccgcggaagaccaauugggauccuaugaaguacgggggccucgacucccccaacauggccuaugccguggugaucgaguacgcuaaaggaaagaauaaacuggucuuugaaaagaaaauuauccgcgugacaauuauggagagaaaggccuucgaaaaggaugagaaagcguuucuggaggaacagggcuaucggcagccuaagguucuugcuaaacugcccaaguacacgcucuaugagugugaagaggggagacgccggaugcuggccagcgccaacgaagcucagaaaggaaaucaacaggugcucccuaaccaucuggucacccuucugcaccaugccgcuaacugcgagguguccgacggcaagucucucgauuacaucgagagcaauagagaaauguucgccgagcugcuggcgcacguuuccgaauuugccaagcgcuauacacuugcugaggccaaccugaauaaaaucaaccagcucuuugaacagaauaaggagggggacauuaaagcuaucgcccaaucuuucguggaucugauggccuuuaacgcuaugggagcgcccgccagcuucaaguuuuucgagaccacaauugaacggaaaagauacaauaaccucaaggagcugcuuaauuccaccaucauuuaccagucuaucacgggccuguaugaaagccgcaagcggcuggacgauaaaagaccggcugccacaaagaaagccgggcaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4850 - RNA, 4364 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaagaaaccguacagcauuggacuggacaucggcaccaacuccguugggugggcgguggugacagaugacuauaagguccccgcuaagaaaaugaaggugcucggaaauacggauaaaucucauauugagaagaaccugcuuggcgcccuccuguucgacagcgggaauaccgccgaagaucggcgccugaaaagaacagcucggcgcagauacacccggcgcagaaaccggauccuuuaucugcaggagauuuucuccgaagagaugggaaagguugacgauucuuucuuucaccgccucgaagacagcuuccuggugacagaggauaagagaggcgagcggcauccuaucuuuggcaaucuggaagaggaagucaaauaccacgagaacuuccccaccaucuaucaucuccgccaauaccuggccgacaauccugagaagguggaucuuagacugguuuaucucgcucuggcccacauuaucaaauuucgggggcacuuccuuauugaaggaaaguuugacacacgcaacaaugaugugcagagacuguuccaggaguuucucgcggucuacgacaacaccuucgaaaauuccucucugcaggagcaaaacguccagguggaagagauccugacggacaaaauuagcaaguccgccaaaaaggaucgggugcucaagcuguuucccaaugagaaaagcaacggcagauucgcugaauuucuuaagcugaucguugggaaucaggccgacuuuaaaaagcauuucgagcucgaagagaaagcuccucugcaguuuucuaaggauaccuacgaagaggagcuugaagugcugcucgcccaaauuggagacaacuaugcggagcuguuccuguccgccaagaaacucuacgauagcauccugcuuucuggcauccugacagugaccgacgucgggacaaaggcuccgcucuccgccagcaugauucagcgcuauaacgaacaccagauggaucuggcucagcuuaaacaauuuauccggcagaagcugucugacaaauacaaugagguguucuccgauguuagcaaggacggauaugccggcuacauugauggcaagaccaaccaggaagccuuuuauaaauaccucaaggggcugcugaauaaaaucgagggauccggcuacuuccucgacaagauugagagagaagacuuucugcgcaaacaacggacguucgauaacgggucuaucccccaucagauccaccuucaggagaugagagcuauuauccgccggcaggcggaauuuuauccuuuccuggccgacaaucaagauagaauugagaagcuccugacauuucgcauccccuacuaugugggaccucuggcucggggcaagagcgacuucgccuggcuuuccagaaaaagcgccgauaagauuacccccuggaacuucgacgagaucgucgauaaagaaucuuccgcugaggccuuuaucaaucgcaugacaaacuacgaccucuaucugccgaaucagaaggugcugccuaaacacagccuccuguacgaaaaguucaccguuuauaacgagcuuaccaaagugaaguacaagacagaacaggggaaaacggcguuuuucgaugcuaauaugaagcaggagauuuuugacggagucuucaaaguguaccggaaggucaccaaagauaagcugauggacuuucucgagaaggaguucgaugaauuuagaaucguggaccugacaggccuggacaaagaaaacaagguuuucaaugccucuuauggcaccuaccaugaucuuugcaaaauucucgacaaggauuuucuggacaacagcaaaaaugagaagauccuggaagauauugugcucacacugacccuuuucgaggaccgggagaugauccgcaagagacuggaaaacuauuccgaucuccugacgaaagagcaagucaagaaacuggaacggagacacuacacaggguggggacgccuuucugccgagcucauucauggcauccggaacaaggaaagcagaaaaaccauccuggacuaucugauugaugacggaaauuccaaccgcaauuuuaugcagcucaucaacgaugacgcucugagcuucaaggaggagauugccaaggcucaggugaucggggaaaccgauaaucuuaaccagguugugucugacauugccggcucccccgcgaucaaaaaggggauccugcaaagccucaaaauugucgacgagcuggugaagaucaugggccaccagccugaaaauauugugguugagauggccagagagaaccaguucacaaaucagggacggcgcaacucucaacagagacugaaaggccuuaccgauuccaucaaggaauuugggagccagauucucaaagagcaucccgucgaaaauucccaacugcagaacgaccggcuguuccucuacuaucugcagaauggacgcgauauguacacaggcgaggaacuugacaucgauuaccugucucaguaugacaucgaucacauuaucccccaggcuuuuauuaaggacaacagcaucgauaauagagugcucacguccucuaaggagaaccgggggaaaagcgacgaugugccuuccaaggacgucgugcgcaaaaugaaaagcuacuggucuaaacugcuguccgccaaacuuauuacccaaagaaaguucgacaaccugacaaaagcugagcggggaggccucaccgaugacgauaaggccggguuuaucaaacgccagcugguugaaacaagacagaucaccaagcacguggcgcggauucucgacgagagauucaauacggaaaccgaugagaacaauaaaaagauccgccaagucaagauugugacacugaaaagcaaccuuguuucuaauuuucggaaggaguucgaacuguauaaagugagagagaucaacgacuaccaucacgcccaugaugcuuaucucaaugccgucauuggcaaggcucugcugggaguguacccgcagcuugaacccgaguuuguuuauggcgacuacccucacuuccacgggcauaaagaaaacaaggccaccgccaagaaauuuuucuacuccaauaucaugaacuucuuuaagaaagaugacgugcgcacagauaagaauggagagauuaucuggaaaaaggacgaacacaucagcaacauuaagaaaguccugucuuauccccaggugaauaucgugaagaaagucgaggagcagaccggcggguucagcaaggaauccauucucccuaaaggaaacagcgauaagcugaucccccggaaaacgaagaaguuuuacugggacacaaagaaguauggcggguucgacucuccgauuguugcuuacuccauccucgugaucgcggauauugagaaaggcaagagcaaaaagcugaagaccgugaaagcccuugucggagugacaaucauggaaaagaugaccuuugagagagacccuguugcuuuccuggagcgcaaaggcuaucggaaugugcaagaagagaacauuaucaagcuccccaaauacucccuguuuaagcuggaaaacgggagaaagcgccuucuggccucugcccgggagcuccagaaaggaaaugaaauuguccugccuaaccaucucggcacccugcuuuaucacgcuaagaauauccauaaaguggaugagcccaagcaccuggacuacguugauaaacacaaggacgaguucaaggaacugcucgauguggucagcaacuuuuccaaaaaguacacacuggccgaggggaaucuugaaaagaucaaggagcuguaugcgcagaacaauggagaagaccucaaagagcuggcuucuagcuucauuaaccuccugacguuuaccgccaucggcgccccugcuacauucaaguuuuucgauaaaaauauugacagaaagcgguacaccuccacaaccgagauccuuaacgccacgcugauucaucaaucuaucacagggcuguaugaaacccgcauugaucucaauaagcugggcggagacaaaagacccgcggcuaccaagaaagccggccaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4851 - RNA, 3497 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugcccagacaacaaaccugagcuacauucucggacuggaccuuggcaucgcguccguugggugggcugugguggagauuaaugaaaacgaggauccgaucggacugauugacgucggcgugcggaucuucgaacgcgccgagguucccaagacgggggaaucucucgcccugagcagacggcuugcucgcuccaccagacggcugauccgcagacgggcccaucgccuccugcuggcuaaaagauuucucaagcgggaggggauucugucuacaaucgaucuugagaagggccugccuaaucaagccugggaacuccgcguggcgggccuggagagacggcuuagcgccauugaauggggagcuguccugcuccaccugaucaaacaucgcggauaucuguccaagcggaaaaacgagucucagaccaauaacaaggagcucggcgcccugcuuagcgggguggcucagaaucaccagcugcuccaauccgacgauuacagaacacccgccgaacuggcgcuuaaaaaguucgccaaggaggaaggacauauuagaaaccagcgcggcgcuuauacccacacauuuaaucggcuggaccuccuggccgagcugaaccuccuguucgcucagcagcaccaauuugggaauccucauugcaaagaacacauccagcaguacaugaccgagcuucugauguggcagaagcccgcccucagcggagaggccauucugaaaaugcuuggcaaguguacgcaugaaaagaacgaguucaaagcugcgaaacacaccuauucugccgaaagauuuguuuggcugacaaagcucaauaaccugcgcauccuggaggauggcgcugaacgggcccucaaugaggaggaaagacaacugcuuaucaaccacccuuacgagaaguccaaacugaccuaugcccaggugcgcaagcuccuggggcugagcgaacaggcuauuuucaaacaucuucgguacucuaaggagaacgccgaauccgcgacauuuauggagcucaaggcuuggcacgccaucagaaaagcccuggagaaucaaggacugaaggacaccuggcaggaucucgcuaaaaagccggaccugcuugaugaaauuggcacggccuucagccuguacaaaacagacgaggauauccagcaguaucucaccaacaagguccccaauucugugauuaacgcucugcuggugucccuuaauuuugacaaauucaucgaacucagccugaagucccugcgcaagauccucccucugauggagcaagggaaacgguacgaccaggccugcagagagauuuauggacaucacuacggcgaagcgaaccagaagacaucucagcuucugcccgccaucccugcucaagagauucgcaaucccgucguucuccggacccugagccaggccagaaaagugaucaacgcuauuauccggcaguauggguccccggcccgcgugcauaucgaaaccggaagagagcugggcaagagcuuuaaagaacggagagagauucagaagcaacaggaggauaaucgcacaaagcgggaaucugcgguccagaaauucaaggagcuuuucuccgacuuuagcucugaaccuaaaagcaaggauauccucaaauucagacuguacgagcagcaacacggcaagugucuguauuccgggaaagaaauuaacauccaccgccucaaugagaagggauacguggagauugaccaugcccugcccuuuucuagaacgugggaugacagcuucaacaauaagguucuugugcuggcuuccgaaaaccagaauaaaggcaaccagaccccuuacgaguggcuccaagggaagaucaacagcgaacgguggaaaaauuuugucgcccuggugcugggaucucagugcuccgcugccaagaaacagcgccuucucacacagguuauugaugacaacaaguucaucgauagaaaucugaacgacacccgguauaucgcccgcuuucugagcaauuacauucaagagaaccuccugcuugugggcaagaauaaaaagaacgucuucacacccaaugggcagaucaccgcucugcucagaucucgguggggccugauuaaagcgcgcgaaaacaauaacagacaccaugcccuggaugcuaucguggucgccugugccacgcccuccaugcagcagaagauuacacgguuuauccgcuucaaagaggugcacccuuauaagaucgagaauagauacgaaaugguugaccaagagagcggagaaauuaucuccccgcacuuucccgagccuugggcuuauuuccggcaggaggugaacauuagagucuuugacaaucaucccgauaccgugcuuaaggaaaugcugccugaccgcccccaggccaaccaccaguucguucaaccucucuucgugucucgggcgccgaccagaaaaaugagcggccaggggcauauggagacaaucaaguccgcuaaacgccuggccgaaggaauuucuguccuccggaucccccugacccagcuuaagccuaaccugcucgagaauauggugaacaaagaaagagagcccgcccuguacgcuggccugaaggcccgccuugcggaguuuaaucaagauccugcuaaggccuucgccacacccuuuuauaaacaagggggacaacaggugaaggcuauccggguugaacagguccagaaaagcggcgugcuggugagagagaacaauggggucgccgacaacgcuuccauugugcgcacggauguuuucaucaagaauaacaaauuuuuccucgugccgauuuacaccuggcaggucgccaagggcauccugccuaauaaagcgauuguggcccacaagaacgaagacgagugggaagagauggaugagggagcuaaguuuaaauucagccucuuucccaaugaccugguugaacuuaagaccaaaaaggaguacuucuuuggcuauuacaucgggcuggaucgggccacaggaaacaucucucucaaagaacaugacggcgagauuuccaaggggaaggauggaguguauagagucggcgugaaacuggcucugagcuucgaaaaguaccagguugacgagcuugggaaaaaucggcagaucugccgcccccagcagagacagccugugcggaagcgcccggccgccaccaaaaaggcuggccaagcgaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4852 - RNA, 3575 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcggcuuucaagccgaaccccauuaauuacauccugggacucgacauuggcaucgccagcguugggugggccaugguggagauugaugaagacgagaacccuaucugccugaucgaucuuggagugcgggucuuugaacgcgcugaggugcccaaaaccggcgacucccuggccauggcuagacggcucgcccgcucuguuagacggcugacacgcagacgggcgcaucgccuucugagagcccggcgccuccugaagagagaaggggugcugcaggcugccgauuucgacgagaauggacucauuaagagccugccuaacacgcccuggcaacuucgggcugccgcgcuggaucgcaaacucaccccucuggagugguccgccguccuucugcaccucaucaagcauagaggcuaucugucucagcggaaaaaugaaggcgagacagcugacaaggaacugggggcccuccugaaaggaguggcugauaacgcccacgcccuucagaccggcgacuuuagaacaccggcugagcuggcgcucaauaaguucgagaaggaaagcgggcauauucgcaaccagcggggagauuacucccacaccuuuucuagaaaagaccugcaagccgagcuuauccuccuguucgaaaagcagaaagaguuuggcaauccccacguuagcgggggacugaaggaaggcauugagacacugcucaugacccagcgcccugcucuguccggcgaugccgugcagaaaaugcuugggcauuguacguucgagcccgccgaaccuaaggcugccaaaaacaccuauacagcggagcgguuuaucuggcugaccaagcucaauaaccugcgcauucuugaacaaggaagcgagagaccccugacagacaccgaacgggcuacgcucauggacgagccguacagaaagucuaaacugacauaugcccaggcccgcaagcugcucggccuggaggauaccgcuuucuuuaaagggcuucgguacggaaaggacaaugccgaggcuuccacacugauggaaaugaaagccuaucacgcgaucagcagagcccucgaaaaggagggccugaaggauaaaaagucuccucugaaccuuucccccgaacuccaggacgagaucgggaccgcuuucagccuguuuaaaaccgaugaggacauuacaggacgccugaaggaucggauccagccugaaauucucgaggcccugcuuaaacauaucucuuucgacaaguucguccaaauuucccugaaggcucucagacggaucgugccccugauggaacagggcaaacgcuacgaugaggccugcgcggagaucuacggcgaccacuaugggaagaaaaauacggaagagaagauuuaccugcccccuaucccggccgaugaaauuagaaaccccgugguccuucgggcucucagccaggccagaaaaguuaucaacggaguggugcgccgguauggcuccccugcucgcauucacaucgagaccgccagagaagucgggaagucuuuuaaggacagaaaagagaucgagaagcggcaagaagagaaucgcaaagacagagaaaaggccgcugcgaaauuccgggaguacuuucccaacuucgugggagaaccuaagagcaaagauauucugaagcugcgccucuaugagcagcagcauggcaagugucuguacuccgggaaagagaucaaucuuggcagacugaacgaaaagggauauguugagauugaccacgcccuccccuuuagccggacaugggaugacucuuucaauaacaaagugcugguccugggcuccgaaaaucagaacaaggggaaucaaaccccguacgaguacuuuaacggaaaagauaauagccgcgaauggcaggaguucaaggcuagaguggagacaucucgguuuccucgcagcaagaaacagagaauccuucuccagaaguucgacgaagauggcuuuaaagagcggaaccugaaugacaccagauauguuaaccgcuuccugugccaauuuguggccgaucggaugagacucacggggaagggcaaaaagcgcgucuucgccuccaauggacagauuacaaaccugcuucggggguucuggggccugagaaaggugcgcgcugaaaacgaccggcaucacgcccucgaugcggucgugguugcuuguucuaccguggccaugcagcagaaaaucaccagauuuguccgcuacaaggagaugaaugccuucgacggaaaaacaauugauaaggagaccggcgaagugcugcaucagaaaacacacuuuccccagccuugggaguucuuugcucaggaaguuaugauccggguguucgggaagcccgacggaaagccugaguuugaagaggccgacacgcccgagaaacugagaacccuucucgcggaaaagcugagcucccggccggaggcuguccacgaauaugugacaccucuguucgugagccgcgcccccaacagaaaaaugucuggccaggggcauauggagaccguuaaguccgccaaacggcucgaugaaggagucagcgugcugcgcgugccccuuacacaacugaagcucaaagaccuggagaagauggucaauagagagcgggaaccuaagcuguacgaggcucuuaaagccagacuggaagcucacaaggaugacccggccaaagcguuugccgagcccuucuauaaguacgauaaagcuggcaaccgcacccaacaggugaaggccguucggguggaacaaguccagaagacggggguguggguuagaaaucauaacggcaucgcugacaaugccaccauggugcgcgucgauguguuugagaaaggagacaaguauuaccucguuccuauuuacucuuggcaaguggccaaaggcauccugcccgaucgggcugucgugcaggggaaggacgaggaagauuggcagcucauugacgauuccuucaacuuuaaauucagccugcacccuaaugaccuuguggaggucaucacaaagaaggcgagaauguucggauauuuugccuccugccaccgcggcaccgggaacauuaauauccggauccaugaccuggaucacaaaauuggaaagaacggcauccucgaagggauuggcguuaaaacagcucugucuuuccagaaguaccagaucgacgagcugggaaaagagauuagacccugucgccuuaagaagagaccucccgugcggaaacgcccggccgccaccaagaaagcuggccaggccaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4853 - RNA, 3581 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccaaguaccauguuggaauugacgugggcaccuucagcguggggcuggcggcuaucgaggucgaugacgccggaaugccgauuaaaacacucucccuggugucucacauccaugauagcggccuugaccccgaugaaauuaaguccgccguuacgcggcuggcuucuagcgggaucgcccgcagaacccggcgccucuauagacggaagcgcagacggcugcagcaacuugacaaauuuauccagcgccagggauggccugugauugagcuggaagauuacuccgacccccucuauccuuggaaggucagagcugagcuggccgcgucuuacaucgccgaugaaaaagagcggggcgagaagcugagcguggcucuccgccacauugccagacaucggggcuggcgcaaccccuaugcuaaaguuuccagccuguaccuuccugacgggccgucugaugccuucaaggcgaucagagaagagauuaagcgggccuccggacagcccgugccugaaacagcuaccgucggccaaauggugacacugugcgagcucgggacccugaaacuuagaggagagggcggggugcugagcgcccgccuccagcagucugacuaugcucgggaaauccaggagauuuguagaaugcaagaaaucggacaggagcuguaccgcaagaucauugaugucguuuuugccgccgaaucccccaaaggcagcgcuucuucccgggugggcaaggacccucugcagcccgggaaaaauagagcgcucaaggccagcgacgcuuuccagcgcuaccggaucgccgcccugauuggaaaccuuagagugcgcgucgauggcgagaaacggauccuguccguggaggaaaagaaucucguuuuugaccaccuggugaaccuuacaccgaagaaagagccugaaugggucaccauugcugagauccuggggaucgauagaggacaacucauuggcacggccaccaugacagacgauggggaacgcgcgggagcucggcccccuacccacgacacaaauagaucuaucgugaacagccggauugcuccccugguugauugguggaagaccgccuccgcccuggagcagcaugccauggugaaagcucucagcaaugccgaggucgacgauuucgacucucccgaaggcgcgaaggugcaggccuuuuucgcugaucuggacgacgauguccacgccaaacuugacucccugcaucucccugugggccgcgcugccuauagcgaggauacgcugguuagacuuacacggagaaugcugucugacgggguggaucucuacaccgcgcgccugcaagaauuuggaaucgagccgagcuggacacccccuacaccccggauuggcgaaccugucgggaaccccgccguggacagaguucugaagaccgugucccgcuggcucgagucugcuaccaagacguggggagccccggagagagucaucaucgaacacgugcgggagggcuucgugaccgaaaaacgcgcuagagagauggauggggacaugcggcgcagagccgcccggaaugcuaagcuguuucaggagaugcaggaaaaacuuaacguucagggcaagccuagccgcgcggaucuguggagauaucaauccguccagcggcagaauugccagugugccuacugcggaagccccauuacauucucuaacuccgagauggaccacaucgugccucgcgcuggccaagggagcaccaauacaagagaaaaccucguggccgucugucaucggugcaaucagucuaaaggaaacacccccuuugccauuugggcuaagaacacguccaucgagggcgugagcguuaaggaagccguggagagaacacgccacugggucaccgauaccgggaugcgguccacagacuucaaaaaguucaccaaagcggugguugagagauuucagcgcgcuacaauggaugaagagauugacgcccggucuauggaaagcguggccuggauggcuaaugagcugagaucccgcgucgcccagcauuucgcgucucacggaacgaccgugcggguuuauagaggcagccugacagcugaagcccgccgggccuccgggaucagcggcaagcugaaauuuuucgacggagugggcaagucuagacucgaucggcgccaucacgcuauugacgccgcugucaucgccuuuaccuccgauuacguggcggagacacuggccgugagaagcaaccugaagcaaucucaggcucaccggcaggaggccccucaguggcgcgaauuuaccgggaaagacgcugagcauagagccgccuggcgggucuggugucaaaagauggaaaaacucuccgcucugcuuacggaggaucugagagacgaucgcguuguggugaugagcaauguccggcucagacugggaaacggcucugcgcacaaggaaaccaucgggaaacugagcaaggugaaacuuuccagccagcucucuguuuccgacauugauaaggccagcuccgaggcucuguggugcgcccugacacgcgagcccggauuugacccgaaggaaggccucccugccaaucccgagcggcauaucagagugaacgggacccacgucuaugcuggcgauaauauuggacuguuccccgugucugccggcagcaucgcgcuucgcgggggauacgcugaacugggcuccucuuuucaccaugcccggguuuacaaaauuacaagcgggaagaaaccugccuucgcuaugcucagaguguauaccaucgaccugcugccguaccgcaaccaggaucuuuucuccgucgagcucaagccccaaacgaugucuaugagacaggccgagaaaaagcugcgggacgcgcuggcuacaggaaaugccgaauaucucggcuggcuggugguugacgaugagcuuguggucgacaccagcaagaucgccacagaucaggugaaagcuguggaagccgagcuggggaccauucgcagauggcgggucgacggcuucuuuuccccuagcaagcuccgccugagaccccugcagaugucuaaagaaggaaucaagaaagaguccgcuccugagcuuagcaagauuaucgaucggcccggcuggcucccugccguuaacaagcuguucucugacgggaaugugaccguggucagacgcgauucccugggacgggugagacucgaaagcacagcgcaccuucccguuacguggaaagugcaaaagcgcccggccgcuaccaaaaaggccggccaggcuaaaaagaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4854 - RNA, 3281 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccgcgcggauucuggcuuucgacaucggaauuagcuccaucggcugggccuuuucugagaacgaugaacucaaggacugcgggguucgcauuuucaccaaaguggagaauccgaagacaggagaaagccuggcccuucccagacggcuggcucgcuccgccagaaagcggcucgcucgcagaaaagcccggcugaaccaucuuaagcaccugaucgcgaaugaguuuaaacucaacuacgaagauuaucagucuuucgacgagagccuggccaaggcuuacaaaggcucccugaucucuccuuaugagcuccgcuuuagagcccugaaugaacuucugagcaagcaagauuucgcucgggugauucuccauaucgccaagcgcagaggguacgacgauauuaaaaacuccgacgauaaggagaaaggagcgauccugaaggccauuaaacagaaugaagagaaacuugcuaacuaucagagcgucggcgaguaccuguauaaagaauacuuucagaaguucaaggaaaauucuaaagaauuuacgaacgugcggaauaagaaagaguccuacgaacgcuguaucgcccagagcuuccucaaggacgagcugaaacugauuuuuaagaagcaaagagaguucggcuuuucuuucuccaaaaaguucgaagaggaaguucucagcguggcuuuuuauaaacgggcccugaaggauuucucucaccuugucgggaacugcuccuuuuucaccgacgagaaaagagcccccaagaauagcccucuggcuuuuauguucguggcgcucacacgcaucaucaaccugcuuaauaaccugaagaacaccgaaggcauucucuacacaaaagaugaccugaaugcccugcucaacgagguucugaagaauggaacccuuacauauaaacagaccaagaaacugcucgggcuguccgacgauuacgaguuuaagggagaaaagggcacguauuucaucgaguuuaaaaaguacaaagaguucauuaaggcucuuggggagcauaaccugucucaggacgaucucaaugaaaucgccaaagacauuacccugaucaaggaugagaucaaacugaagaaggcccucgcuaaauaugaccugaaccaaaaucagauugauagccuuuccaagcuggaguuuaaagaccaccucaacaucagcuucaaggcccugaaacuggugacaccccuuaugcucgaaggaaagaaguacgaugaggcguguaaugaacugaaccugaaagucgcuauuaaugaggacaagaaagauuuucucccugccuucaacgagaccuacuauaaggacgaagugacaaauccggugguccugcgggccaucaaagaguacagaaagguucuuaacgcucugcucaagaaauauggcaaggugcacaaaauuaauaucgaacuggcccgcgaggugggcaagaaccauucucagcgggcuaaaaucgaaaaggagcagaacgagaauuacaaggccaaaaaggacgcggaacuggagugcgaaaaacuugggcucaagauuaacuccaaaaauauccugaagcugagacucuucaaagagcaaaaggaauuuugugccuauagcggagagaagauuaaaaucucugaucugcaggacgagaagaugcuugaaauugaucacaucuaccccuauagccgcuccuucgacgauucuuacaugaacaaaguccugguguuuaccaagcagaaucaagagaaacucaaccagacgccuuucgaggcuuuuggcaaugacagcgccaaguggcagaagauugaaguucuggcuaaaaaccugcccacaaagaaacagaagcggauccuugauaaaaauuacaaggacaaggaacaaaagaacuucaaggauagaaaucucaacgacacccgcuauaucgcccggcuggugcugaauuacacaaaagauuaucucgacuuucugccucuuuccgaugacgagaacaccaagcugaaugacacccagaaagggagcaagguccauguggaggcgaagucuggaaugcucacauccgcccugagacacacguggggcuucagcgcuaaagaucgcaacaaccaucugcaccacgccauugacgcuguuaucauugccuacgccaauaacucuaucgugaaggcuuuuuccgauuucaaaaaggaacaggagagcaauuccgcggaacuuuaugccaaaaagauuucugagcucgacuacaagaacaaacggaaguuuuucgagcccuuuagcggguucagacagaaaguccuggauaagaucgacgaaaucuucguguccaaaccggagcggaagaaaccuucuggagcucugcaugaagagaccuuucgcaaggaagaggaguucuaucaaagcuacggcggcaaggaagggguccucaaagcccuggagcuuggaaagauuagaaaagugaauggcaagaucguuaaaaacggggauauguuucggguggacauuuucaagcacaagaaaacaaauaaguuuuacgccguccccaucuauaccauggauuucgcucugaaagugcucccuaacaaggccguugcgagauccaaaaagggagaaauuaaggacuggauccugauggaugagaauuacgaauuuugcuucagccuguauaaagacucucuuauccugauucagacaaaggauaugcaggagcccgaguuuguguacuauaacgcuuucaccuccagcacggucucucucaucguguccaaacaugacaauaaguuugaaacacugagcaaaaaccagaagauucucuucaagaaugccaacgagaaagaagugaucgccaagucuauuggcauccaaaaucugaaaguuuucgagaaguacaucgucagcgcucuuggggaagugaccaaagccgaguuucgccagcgggaggacuucaagaaaaagagacccgcggcuaccaagaaagccggccaggccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4855 - RNA, 3692 nt, Artificial Sequence
  Cas9 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcgaccugguucucggacuggauauuggcaucggguccgugggagugggcauucuuaacaaggucaccggggagaucauucauaaaaauucucggaucuucccggcggcucaggccgaaaacaaucuggugcgcagaacaaaccggcaaggacgcagacucgcccggcgcaagaagcacagacggguucgccugaauagacuuuuugaggaaagcggccugaucacggacuucaccaaaauuuccaucaaccucaaucccuaccagcugcgggugaagggccugacagaugagcucucuaacgaggagcuguuuauugcucuuaaaaauauggucaagcaucgcgggaucagcuaucuggacgaugccuccgacgauggaaacucuagcgugggcgacuacgcucagauuguuaaagaaaauuccaagcagcucgaaaccaagacaccugggcaaauccagcuggagagauaucagaccuacggacagcuucggggcgauuucacaguggaaaaagacgggaagaaacaccgccugauuaacgucuuucccaccagcgccuauagaucugaggcgcuccggauccugcaaacgcagcaggaguucaauccucagaucaccgaugaauuuauuaacagauaccuggagauccucacaggaaagcgcaaauauuaccauggccccggcaaugaaaagucccggaccgacuacgggagauaucgcacaagcggagagacccuggauaacauuuucggcauccuuauugggaaaugcacguuuuacccugacgaguuccgggccgcuaaggccucuuauacagcucaagaauuuaaccugcucaaugaccugaacaaucuuaccgugccgacagagaccaagaaacuguccaaggaacagaaaaaccagaucaucaauuacgugaagaacgagaaagccaugggacccgcgaaacucuucaaguauauugccaaacugcugagcugugaugucgcugacaucaagggcuacagaauugauaaaucugggaaggccgaaauccacaccuuugaggcuuaucgcaaaaugaagacacucgaaacgcuggacauugagcaaauggaucgggagacccuugacaagcuggccuacguucucacacugaauaccgaaagagagggaauccaggaagcccuugagcacgaguucgcugauggcuccuucagccagaaacagguggacgaacuggugcaauuucgcaaggcgaacuccucuaucuucggcaaaggguggcauaauuuuagcgucaagcucaugauggagcugauuccugaacuguacgagacauccgaggaacagaugaccauccucacgcggcugggaaaacagaagacaaccucuucuuccaacaagaccaaauauauugaugagaaacuucugacagaagagaucuacaaucccgugguugccaagagcgugagacaggcuauuaagaucgucaacgccgccauuaaagaauauggcgacuucgauaauaucgugaucgagauggcucgcgaaaccaacgaggacgacgagaagaaagccauucaaaagauccagaaggcgaauaaagaugaaaaggacgcugccaugcucaaagccgcuaaccaguacaacgggaaggccgagcugccucacucuguuuuucauggacacaaacagcuggcuacaaagauucggcuuuggcaccaacagggcgaaagaugccucuauacggggaagaccaucagcauucaugaucugaucaauaacuccaaucaguucgagguggaccacauccugccccucucuauuacauuugaugacagccuggccaacaaaguccuuguguacgcgaccgccaaucaggaaaagggccaacggacaccguaucaggcucuggauuccauggacgaugccuggagcuuccgcgagcucaaggcuuuugucagagagucuaagacccuguccaacaaaaagaaggaauaccugcuuacggaggaagacaucagcaaauucgaugugcggaagaaauuuauugagagaaaucucguugacacccgcuacgccucucgggugguccugaacgcgcugcaggaacauuucagagcccacaagaucgauacaaaaguguccguugugcgcggacaauuuaccagccagcucagacggcauuggggcauugagaagacacgcgacaccuaucaccaccaugcugucgacgcccugaucaucgcugccuccucucagcuuaaucuguggaagaaacagaagaacacgcucgugagcuacuccgaggaucaacugcuggacauugaaacaggggagcuuaucucugaugacgaauauaaagagagcguguucaaggccccuuaccagcacuucguugauacccucaaauccaaggaguuugaagacagcauucuguucucuuaucaggucgauuccaaauuuaauagaaagaucagcgacgcuacaauuuacgcgacccggcaggccaaggugggaaaagauaaggcugacgagaccuaugugcugggcaaaaucaaggauaucuacacacaagacggguacgaugccuucaugaaaauuuauaagaaggacaaaucuaaguuucucauguaccgccaugacccccagacguucgaaaaagucaucgagccuauucuggaaaacuaucccaauaagcagaucaacgagaaaggaaaggaggugcccuguaauccuuuucuuaaguacaaagaggaacacggcuauauuagaaaguacuccaaaaaggggaacggcccggaaaucaaaagccugaaguauuacgauucuaagcucggaaaccacauugacaucacccccaaagauagcaauaacaagguugugcugcaguccgucagcccuuggcgggccgacguguacuucaauaaaacaaccggcaaguaugagauccuggggcuuaaauacgcugaucuccaauuugaaaagggaacaggcaccuauaagauuucucaggagaaauacaacgacaucaagaaaaaggaggggguugauuccgacagcgaguucaaauuuacgcuguauaagaaugaucugcuccuggugaaagacacagaaaccaaggaacagcaacuuuuccgcuuucuguccagaaccaugcccaagcagaaacauuacgucgagcucaagccuuaugauaaacagaaguucgaaggaggcgaggcccugauuaaagugcuggggaacguugcgaauagcggccagugcaagaagggacuuggcaaaagcaacaucuccauuuacaaggugcggacagacguccuggggaaucaacacaucaucaaaaacgagggagacaagcccaaacucgauuucaagcgcccggcugccaccaagaaagccggccaggcuaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4856 - RNA, 4250 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccacccaguucgagggauuuacaaaccuguaccaaguuagcaagacgcuccgguucgaacugauuccgcagggcaaaacccuuaagcauauccaggagcagggguuuauugaagaggacaaggcgcgcaaugaucacuauaaagaacugaagcccaucauugacagaaucuacaaaacauaugcugaucaaugccuccagcuggugcagcuugacugggagaaccuguccgccgccaucgauucuuaccggaaggagaaaaccgaagagacacgcaaugcucucauugaagaacaggccaccuauagaaacgcuauccaugacuacuucauuggacggacagauaaucugaccgacgccaucaacaagcgccacgcggagauuuauaagggccuguuuaaagccgaacucuucaaugggaaggugcugaaacaacuuggaacggucaccacaaccgagcaugaaaacgcucugcucagauccuuugauaaguucacaaccuacuuuagcggcuucuacgagaaucggaaaaacguguuuucugccgaagacaucagcacggcuauuccucaccgcaucguucaggauaauuuccccaaguuuaaagagaacugucacaucuucacaagacugauuaccgccgugccuucccuucgggagcauuucgaaaaugucaagaaggcgaucggcauuuuugugucuacaagcaucgaggaaguuuucuccuuucccuucuauaaccagcugcucacccagacccaaauugaccuguacaaucagcugcucgggggaaucagccgcgaggccggcacagagaaaaucaaggggcugaacgaggugcuuaaccuggcuauucagaaaaaugaugagacggcccacaucauugcuucucucccucauagauuuaucccgcuguucaagcaaauucuuuccgaccggaacacccugagcuuuauccucgaagaguucaaaucugacgaagaggucauccaguccuuuugcaaguauaagacacugcugcgcaaugaaaacgugcucgagaccgccgaggcccuguucaaugaacuuaacagcauugaucugacacacaucuuuauuucucacaaaaagcucgagaccaucuccagcgcucugugugaccauugggauacgcuuagaaaugcgcuguacgaacggagaauuuccgagcucacaggaaaaaucaccaagucugccaaagagaaggugcagcgcagccugaagcacgaagacauuaaccugcaggagaucaucuccgcugccggcaaagaacucagcgaggccuucaagcagaaaaccucugaaauucugucccaugcucacgccgcgcuugaucaaccccugccuacaacccucaagaaacaggaggagaaggaaauccuuaagagccagcuggacucucuucucgggcuguaucaucugcucgauugguuugcugucgacgagagcaaugaaguugaucccgaguucuccgcccggcugacaggaauuaaacuugaaauggagccuucucugagcuucuacaacaaggccagaaauuaugcuacgaaaaagcccuacuccguggagaaauuuaagcucaacuuccaaaugccgacccuggccagcggcugggacgugaauaaagaaaagaacaauggcgcuauccuguuugucaagaacgggcuuuacuaucucggaauuaugccuaaacagaagggccgcuacaaagcccugucuuucgagcccacagaaaagaccuccgagggguuugauaaaauguauuacgacuauuucccugacgcggccaagaugauccccaagugcagcacacagcugaaagcugugaccgcccacuuucagacgcacaccacacccauccuccugucuaacaauuucauugaaccucuugagaucaccaaggagauuuacgaucugaacaauccggaaaaagagcccaagaaauuucaaacagcuuaugccaagaagaccggagaccagaaaggcuaccgggaagcgcucuguaaguggaucgauuucacgagagacuuucuguccaaauacacaaagaccacaagcauugaucuguccucucuucgcccuagcucccaguauaaagaccucggggaguacuaugccgagcugaacccccugcucuaccauaucucuuuccagcggaucgcugaaaaggagauuauggaugccguugaaaccggaaagcuguaucuuuuucaaaucuacaauaaagacuucgcuaagggccaccauggcaaaccuaaccugcacacccucuauuggacagggcuguucagccccgagaaucuggccaagacguccauuaaacuuaacggacaggccgaacucuuuuacagaccuaagagccgcaugaaacggauggcucacagacugggcgagaagaugcugaauaagaaacucaaggaucagaaaaccccgauccccgacacacuguaccaagagcuuuaugauuacgugaaccaucgccugucucacgaccucuccgaugaagcgcgggcccugcugccuaaugucauuaccaaggaggugagccaugaaaucaucaaagacagacgguucacaucugacaaguuuuucuuucacguucccauuacccuuaacuaucaggcugccaauuccccuagcaaguucaaccagcgcgugaaugccuaccugaaagagcaucccgaaacgccgaucauugggaucgauagaggagagcggaaccucauuuauaucacagucauugacucuaccggcaagauccuggagcagagaagccucaacaccauccaacaguuugauuaccagaaaaagcuggacaaucgcgaaaaagagcggguggcugccagacaggcgugguccgucguggggacaauuaaggaucuuaagcaaggcuaucugagccagguuauccacgaaauuguggaccucaugauccacuaccaggcugucgugguucuggagaaccugaauuucggauuuaaaucuaagcgcaccggcauugccgaaaaagccguguaccagcaauucgagaagaugcuuaucgauaaacugaacugccucguccugaaggacuauccugcugagaagguugggggagugcucaaucccuaccagcugacagaucaguuuacguccuucgccaaaaugggcacccaaagcggguuccuguuuuaugugcccgcgccuuacacauccaagaucgacccgcugaccggauucgucgaucccuuuguguggaaaacaauuaagaaccaugaaucuagaaaacacuuccucgagggcuuugacuuccugcauuaugaugugaagaccggggacuuuauccugcacuucaagaugaaucggaaccuuagcuuucagcgcggccugccuggauucaugcccgcuugggacauugucuuugagaaaaaugaaacgcaguucgaugccaagggcaccccuuuuaucgccgggaaaagaauugugcccguuaucgagaaccaucgguucacaggacgcuacagagaccucuauccugcuaaugaacugaucgcccuccuggaggaaaagggcauuguguuccgggauggguccaacauccuucccaaacugcuggagaaugacgauucucacgcuauugacaccauggucgcccucauccgcagcgugcugcagaugagaaacuccaaugcggccacaggagaagauuacauuaacucuccgguucgggaccuuaacggcguguguuuugauagccgcuuccaaaauccugaguggcccauggacgcugaugccaacggggcuuaccacaucgcccugaagggccagcuccugcucaaucaucugaaagaguccaaggaccuuaagcugcagaacggaauuagcaaucaggacuggcuggccuauauccaagaacucagaaacaaacggccugcugcgaccaagaaagccggccaggcuaagaaaaagaaguaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4857 - RNA, 4229 nt, Artificial Sequence
  Cpf1 variant mRNA product
gggagagucccgcagucggcguccagcggcucugcuuguucgugugugugucguugcaggccuuauucaagcuuaccauggcccccaagaaaaagagaaaagugggcauccacggggucccugcugccagcauuuaccaggaguucguuaacaaguauucccugucuaaaacccuccgguuugaacugaucccgcaaggaaagacacuugagaauauuaaggcgcgcggccugauccucgacgaugaaaagagagcuaaggacuacaaaaaggccaaacagauuaucgauaaguaucaucaguucuuuaucgaggaaauucugagcuccgugugcaucucugaggaccuucugcagaacuacagcgauguguauuucaagcucaaaaaguccgacgaugacaaucugcaaaaagauuuuaagucugccaaagacacgauuaagaaacagaucagcgaguacauuaaggauuccgaaaaguucaaaaaccuguuuaaucagaaccucaucgacgcuaagaaagggcaggagagcgaucugauucuuuggcugaagcaaucuaaagacaauggaaucgaacucuucaaggccaacuccgacaucaccgauauugacgaggcucuggagaucauuaagagcuuuaaaggcuggacaaccuauuucaagggguuucacgaaaaucggaaaaacgucuacucuuccaaugauauccccacaagcauuaucuaccgcaucguggacgauaaccuuccuaaguuccuggagaauaaagccaaguaugaaucucucaaggacaaagcgcccgaggccauuaacuacgaacagaucaagaaagaucuggcugaggagcugaccuuugacauugauuauaagacauccgaaguuaaucagagaguguucagccucgacgaggucuucgaaaucgccaacuuuaacaauuaccugaaccaguccggaauuaccaaauucaauacgaucaucggcggcaaguuugugaacggggagaauaccaagcggaaaggaauuaacgaauauaucaaucuuuacucucaacagauuaacgauaagacacugaaaaaguauaaaaugagcguucucuucaagcagauccuguccgacaccgagagcaaaucuuuugugauugacaaacuugaggaugacuccgaugucgugacaaccaugcagagcuucuacgaacaaaucgcugccuuuaagacgguggaggaaaaaucuauuaaggagacacugagccuccuguucgacgaucugaaagcgcagaagcucgaccuguccaaaaucuacuuuaagaaugauaagucucuuaccgaccugagccagcaagucuucgaugacuauuccguuaucggcacagccgugcucgaauacauuacccagcagaucgcuccuaaaaaccuggauaaucccagcaagaaagagcaggagcuuauugccaagaaaaccgaaaaggcuaaguaucugucucucgagacaaucaaacuggcccuggaagaguuuaacaagcaucgcgacauugauaaacaauguagauucgaggaaauccucgccaauuuugcugcgaucccuaugauuuucgacgagaucgcccagaacaaggacaaucuggcucagauuuccaucaaauaccagaaccaagggaagaaggaucuucugcaggccagcgccgaagacgaugugaaagcuauuaaggaccuccuggaucagacgaacaaucugcuucacaaacucaagaucuuccauaucucucaguccgaggacaaagccaacauucuggauaaggacgaacacuuuuaucuggucuucgaggagugcuacuuugaacucgcgaauaucgugccgcuguauaacaaaauucggaauuacaucacccaaaagcccuacagcgaugagaaguucaaacuuaacuuugaaaauuccacacuggcuaacggaugggacaagaauaaagagccugauaacaccgccauucucuucaucaaggacgauaaauauuaccugggcguuaugaauaagaagaacaauaaaaucuuugacgacaaggccauuaaagaaaacaagggggagggauauaaaaagaucguguacaagcugcuucccggcgcuaauaaaaugcucccuaaggucuucuuuucugccaaaagcauuaaguucuauaaccccuccgaggauauccugcgcauuagaaaccacucuacacauaccaaaaauggcagcccgcagaagggguacgaaaaguuugaguucaacaucgaagacugucggaaauuuauugauuucuauaagcaguccaucagcaaacacccugaguggaaggacuucggauuucgcuucucugauacgcaaagauacaauuccaucgacgaauuuuaccgggagguggagaaccagggcuauaaacugacauucgaaaauauuagcgagucuuacaucgauuccguugugaaccaggggaagcucuaucuguuucagauuuacaauaaggacuucagcgcuuauucuaaaggacgccccaaccuucauacccuguacuggaaggcccucuuugaugaaagaaaucugcaagacgucguguauaaacugaacggcgaggcggagcuuuucuaccggaagcagagcaucccuaaaaagauuacccaccccgccaaagaagcuaucgccaauaagaacaaggauaaucccaaaaaggaguccgucuuugaauacgaccucaucaaagacaagagauucacagaggauaaauuuuucuuccacugcccuauuaccaucaacuuuaagagcucuggggcuaauaaguucaacgacgaaauuaaccugcugcucaaagagaaggccaaugaugugcauauccuguccauugaccgcggagagcggcaccuugcguauuacacacugguugauggcaaaggcaacaucaucaagcaggacacguuuaauauuaucgggaacgauagaaugaaaaccaauuaucaugacaagcucgccgcuauugaaaaggaucgcgacagcgcccggaaagauuggaagaaaaucaacaauauuaaggagaugaaagaaggauaccugucccaggugguccacgagaucgcuaagcuggugauugaauauaacgccaucguuguguucgaggaccuuaauuuuggcuucaagagagggcgcuuuaaagucgagaagcaaguguaccagaaacucgaaaagaugcugaucgagaaacugaacuaucucguguucaaggauaaugaauuugacaaaacaggaggcguucugcgggccuaccagcuuaccgcuccguucgagacauuuaagaagauggggaaacagaccggcauuaucuacuauguccccgcgggauucacgucuaagauuuguccugugaccggcuuugugaaccaacuguaccccaaauaugaaagcgucuccaagucucaggaguucuucagcaaauuugacaagaucugcuacaaucucgauaagggguauuucgaguuuuccuucgacuacaaaaacuuuggagauaaggccgcuaaaggcaaguggacaauugccucuuucgggagcagacugaucaauuuucgcaacuccgacaaaaaucauaacugggauacccgggaaguguauccuacaaaggagcuggaaaaacuucugaaagacuacagcaucgaguacggacacggcgaguguauuaaggccgcuaucugcggggaaucugauaaaaaguucuuugccaaacucaccuccguucugaacacgauucuccagaugagaaauagcaagacaggcaccgagcuggacuaucuuaucucucccguggcggaugucaacggaaauuucuuugacucccgccaagcuccgaagaacaugccucaggaugccgacgccaauggcgcuuaccacauugggcugaaaggacucaugcugcugggccggaucaagaacaaucaggaagggaaaaagcugaaccuugugaucaaaaaugaggaauauuucgaguuuguucagaacagaaauaacaagcggcccgccgcgacaaagaaggcuggacaagccaagaaaaagaaauaaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaaagaauu

SEQ ID NO: 4858 - RNA, 51 nt, Artificial Sequence
  NLS2 variant
auggcaccaaaaaaaaaaagaaaaguaggaauacacggaguaccagcagca

SEQ ID NO: 4859 - RNA, 48 nt, Artificial Sequence
  NLS4 variant
aaaagaccagcagcaacaaaaaaagcaggacaagcaaaaaaaaaaaaa

SEQ ID NO: 4860 - RNA, 4107 nt, Artificial Sequence
  Cas9 variant
auggauaagaaauauaguauaggccuugauauaggcaccaauagcguaggaugggccguaauaacagaugaauauaaaguuccaagcaagaaauuuaaaguauuaggaaacacagaucgacauucaauuaagaaaaaccuaauuggagcacuacuuuucgacaguggagaaacagcagaagcaacucgucuaaaaagaaccgcaagacgaagauauacucgaagaaagaacagaauuugcuaccuacaagaaauauuuucuaacgaaauggcuaaaguagacgacucauuuuuccacagacuagaagaauccuuucugguugaagaagauaagaaacaugaacgacauccgauuuucggaaauauagucgaugaaguggcauaccacgaaaaauacccaaccaucuaccaccuucgaaagaaauuaguggacagcacagacaaagcagacuuaagguuaauauaucuagcuuuggcacacaugaucaaauuccgaggacauuuucuaauugagggagaucuaaaccccgacaacucugaugucgacaaacuauuuauacaauuaguacaaacuuacaaucaacuauuugaggaaaacccaaucaacgccucaggugucgacgcaaaagccauucuaucagcaagauuaucaaaaagccgaagacuagaaaacuugaucgcacaacucccaggagagaagaaaaauggacucuucggaaaucuuauagcgcucuccuuaggcuuaacacccaacuucaaaucaaauuucgaccuagcagaagaugcaaaacuacaacuuuccaaagauacuuaugacgacgacuuggacaacuuacuagcucagauaggagaucaauaugcugaucuauuuuuagccgccaaaaaucucucagacgcaaucuuacuaagugauauucuaagaguaaauacagaaauaaccaaagccccucuauccgcaaguaugaucaaaagauacgacgaacaccaccaagaccugacgcuacuaaaagcccuaguacgucaacaauuaccagaaaaauacaaggaaauauucuuugaucaauccaagaacggauacgccggauacauagauggaggggcaucacaagaagaauuuuacaaauuuauaaaaccaauucuagagaaaauggaugggacggaagaacuauuagugaaacuaaaccgagaagacuuacuacguaaacaaagaacguucgauaauggcucuauaccacaccaaauccacuuaggagaacuacacgccauauuacgacgccaagaagacuuuuauccauuccuaaaagauaaucgagagaaaauagagaaaauuuuaaccuuccgaauaccguauuacguaggcccucucgcgcgugguaacucaagauucgcauggaugacuagaaaaucagaagaaacuaucacaccauggaacuucgaagaagucguagacaaaggagcgagugcucaaucuuuuauagaaagaaugacuaacuucgauaaaaauuuaccaaaugaaaaaguacuaccaaaacacagcuugcuauaugaauacuucacaguauacaaugaacuuacaaaaguuaaauauguaacagaagguaugagaaaaccagccuucuuaagcggagaacaaaagaaagcaaucgucgauuuauuauuuaaaacaaacaggaaaguaacugucaaacaauuaaaagaagacuacuuuaagaaaauagaauguuucgauucaguagaaauaucaggaguagaagaccgauucaacgcaucacuggggacauaccacgaccuacuuaaaauaaucaaagacaaagauuuccuagacaaugaagaaaacgaagauauacuugaagauauaguacuaaccuuaacccuauuugaagacagagaaaugauagaagaaagacuaaaaacuuaugcacaccuauuugaugacaaggugaugaaacaacucaaaagaagaagauacacagguuggggaagacuaucaagaaaauuaaucaauggcaucagagacaaacaguccggaaaaacaauacuggacuuucugaaaucagacggauucgccaacagaaauuucaugcaauuaauacacgaugacagccuaacauucaaagaagauauacaaaaagcucaaguaagcggccaaggggacucucuacaugaacacaucgcuaaccuagcaggaucaccagcaauaaagaaagggauuuuacaaacuguuaaaguuguagacgagcuaguaaaagucaugggaagacauaaaccggaaaauauaguuauagaaauggcacgugaaaaccaaacuacucaaaaagggcagaaaaacucaagagaaaggaugaaaagaauugaagaaggcauaaaagaauuagggagccaaauucuaaaagaacacccaguagaaaacacacaacuucaaaacgagaaacuguaucuuuacuauuuacaaaacgguagagacauguacguagaucaagaauuagauaucaaccgccuaucugauuacgaugucgaccauauagucccacaaucauucuuaaaagaugauucgauagacaacaagguauugaccaggagugacaaaaacagggggaaaucagacaauguaccaucagaagaggugguaaagaaaaugaaaaacuauuggcgacaacuuuuaaaugcuaaauugauaacucaaagaaaguuugauaaucucacgaaagccgaacguggcggccugagcgaacucgauaaagcagguuucauaaaacgacagcuugucgaaacuagacaaauaacaaaacacgucgcacaaauacuggacucaagaaugaauacuaaauacgaugaaaacgacaaauuaauaagagaaguaaaaguaauaacacuaaagucaaaauugguaucagauuuuagaaaagauuuccaauucuacaaaguucgcgaaauaaauaauuaucaucacgcacacgacgcuuaucuaaacgcaguaguaggaacugcacuaauaaagaaauauccuaaauuagaaucagaauuuguauacggcgacuauaaaguguacgauguacgaaaaaugaucgcaaaaucagaacaggaaauaggcaaagcaaccgccaaauacuuuuucuauucuaauaucaugaacuucuuuaaaacagaaaucacacuugcaaacggggaaauacguaaaagaccccuuauagaaacuaacggggaaacaggagaaauaguaugggacaaaggcagagacuuugcaacaguaagaaaaguacuuucaaugccccaaguaaacauaguaaagaaaaccgaaguacaaacgggcggcuuuucaaaagaaucaauuuuaccuaaacgaaacagcgauaaacuaauagcuagaaagaaagauugggauccaaagaaauauggaggauuugauagccccaccguagcauauuccguccuuguaguugcaaaaguagaaaaaggaaaaaguaagaaauuaaaaucggucaaagaauuauuaggaauuaccauaauggaaagaaguucguuugagaaaaacccaauugacuuccuggaagcaaaaggcuauaaagaagucaagaaagaucucauuaucaaacuuccaaaauauagucuauuugaacuagagaauggaagaaaacgcaugcuagcgagcgcuggugaacuacagaaaggaaacgaacuagcauuacccagcaaauacguuaauuuccuauaucuugcaagccauuaugaaaaacuaaaaggcuccccagaagauaaugaacaaaaacaacuauuuguagaacaacauaaacauuaucuagaugaaauuauagaacaaauaagcgaguucuccaaaaggguaauacuagcagaugcaaauuuggacaaaguacuuucggcauauaauaaacacagggauaaaccaaucagagaacaagccgaaaauaucauacacuuauuuacauuaaccaauuuaggagccccagcggcauuuaaauauuuugauacaaccauugacagaaaaagauauacaucaacuaaagaagugcuugacgcaacccuaauacaucaaucgauaacaggauuauacgaaacgcgcauugacuuaagucaacuaggcggugacuga

SEQ ID NO: 4861 - RNA, 4890 nt, Artificial Sequence
  Cas9 variant
augaauuucaaaauacuuccaauagcgauugauuuagguguuaaaaacaccgguguauuuagcgcguucuaccaaaaaggaacgucacuugaaaggcuggauaauaaaaaugguaaggucuaugaacugucaaaagauaguuacacgcuccuuaugaauaaccgaacugcacgaagacaccaacgaagaggcauugauagaaaacaacucgucaaaagguuauuuaaacucauauggacugaacaacugaaccuagaaugggacaaagacacccaacaagccaucaguuuccuuuuuaacagacgaggcuuuucauuuauaaccgauggauauuccccugaauaccucaacauaguaccagagcaaguaaaagcaaucuuaauggauauauuugacgacuauaauggcgaagaugaucucgacucuuaucugaagcucgccacugaacaagaauccaaaauuucagaaaucuacaacaaauuaaugcaaaaaauauuagaauuuaaacucaugaaacuauguacggacauaaaagacgacaaagucucaacaaaaacacugaaagaaauuacgagcuaugaauucgaacuauuagcagacuaucuagcaaacuauucugaaucacucaaaacacaaaaauucucauacaccgacaaacaaggaaauuuaaaagaacucucauacuaccaucacgauaaauacaauauccaagaguuccuaaaacgacacgcaacuaucaaugauagaauacucgauacacuacucacugacgaucuggauauuuggaacuucaacuucgaaaaauucgacuuugacaagaaugaagaaaaacuacaaaaccaagaagauaaagaccauauccaagcacaucuacaccauuucguauuugcaguaaacaaaauaaaaucugagauggcaucagguggacgucacagaucacaauacuuucaagaaaucacuaauguacuagacgaaaauaaccaccaagaaggguacuugaaaaauuucugugagaaccuacacaacaaaaaauacagcaauuuaaguguuaaaaaucuagugaaccuaaucggcaaccuaaguaacuuggaauuaaaaccccucaggaaauauuucaacgauaaaauacacgcaaaagcggaccacugggacgaacaaaaauucacagaaacauacugccacuggauacucggcgaauggagagugggaguuaaagaucaggauaaaaaagacggugcaaaauacucauacaaagaucuaugcaacgagcuaaaacagaaaguaaccaaggcgggacuaguagauuucuuacucgaauuagacccaugcagaacaauuccaccauaccuagacaacaacaauaggaaacccccgaaaugccaaucauuaaucuuaaaucccaaauuucuagacaaccaauauccuaauuggcaacaguacuuacaagagcuaaaaaaauuacaaucaauacaaaauuacuuggauucuuucgaaaccgaucuaaaaguacuuaaaaguaguaaggaccaaccauacuucguagaauauaaauccaguaaucaacaaauagcgagcggacaacgagacuacaaggaucuugacgccagaauuuuacaauuuauauuugaucgaguaaaagcuucugacgaauuauuacuaaacgaaauuuacuuccaggcaaaaaaacugaagcaaaaagcauccucagagcucgagaaauuggaaucuucaaaaaaacuagaugagguaauagcgaauucacaacuuucccaaauacuaaaaagucaacauaccaacggaauauucgaacaggggacauuccuccaucucguguguaaauauuauaagcagagacaaagagcucgagauucacgucuauauaucaugccugaguaccgauacgauaaaaaauuacauaaauacaacaauacugguagauucgacgaugauaaucaacuacuaaccuauugcaaucauaaaccaagacagaaacgauaccaacucuuaaacgauuuagcgggaguacuccaaguauccccuaauuuucuaaaagauaaaaucggaagugaugacgaccucuucaucucgaaauggcugguagaacacauacgcggcuucaagaaagcaugugaagacucccuaaaaauacaaaaagacaauagaggccuacuuaaccauaagaucaauaucgcacguaacaccaaaggcaaaugcgaaaaagaaauauuuaaucuaauuugcaaaauagaaggcucagaagauaaaaaagguaauuacaaacauggcuuagcauacgaacuggggguuuuacuauuuggagaacccaacgaggcaucaaaaccagaauuugacagaaaaaucaaaaaauucaauucaauuuauagcuucgcccaaauucaacagauagccuuugccgaaagaaagggaaacgcaaacaccugcgccguauguagugcagauaacgcucaccgcaugcaacaaauuaagaucacggaaccaguagaagauaacaaagacaaaaucaucuuaagcgcaaaagcacaacgccuaccggcaauaccaaccagaaucguagauggagcggugaaaaaaauggcaaccauacuugcaaaaaauauagucgacgacaauuggcaaaacauuaaacaaguguuaagcgccaaacaccaacuucacauacccaucaucacggagaguaacgcauuugaauucgaaccggcgcucgccgacguaaaagguaaaucucuaaaagauagaaggaaaaaagcccuagaaagaauuagcccagagaauaucuuuaaagacaaaaacaauagaauaaaagaauucgccaaaggaauaagcgcguacucaggagcaaauuuaacagacggcgauuuugacggagcuaaggaagaacuagaccacauuauacccagaagccacaaaaaauauggaacccugaacgaugaagcaaauuuaauaugcguaacacgaggagauaacaaaaacaaagguaauagaauauucugucucagagauuuagccgacaauuacaaauuaaaacaguucgaaaccaccgacgaccuagaaauagaaaaaaaaaucgcugauaccauaugggaugcaaacaaaaaagauuuuaaauuugguaacuaccgcuccuuuaucaaccuaacuccacaagaacaaaaagcauucaggcaugcccuauuccuagcagacgaaaacccuauaaaacaagcuguuauacgagcuauaaacaacagaaaccgaacauuuguuaauggaacacaaagauacuuugcagaaguccuagcaaacaacauuuaccuaagagcgaaaaaggaaaauuuaaacacagauaaaauaaguuucgacuacuuuggaaucccaacuaucggaaauggaagaggcauagccgaaauucgacaacuguacgaaaaagucgacucagauauccaagcauacgcuaaaggcgauaagccacaggcaucauauucucaccuaauugaugcaaugcuugcauucuguaucgcugcagacgaacacagaaaugauggaucaauaggacuagaaauagauaaaaacuauucacuauacccgcuagacaaaaacaccggagaaguuuucacuaaagacaucuuuucacaaauuaagauuacagauaaugaauuuuccgacaaaaaauuaguaagaaaaaaagcuaucgaaggguucaacacucauagacagaugacucgagacggaaucuacgcagaaaauuaccuaccuauauuaauacauaaggaauuaaaugaagucagaaagggauacacuuggaaaaauucagaagaaauaaaaaucuuuaaaggaaaaaaauaugauauacaacaacuaaacaaccuuguuuauuguuuaaaauucgucgauaaaccaauaagcauagauauacaaauauccacccuagaagaauuaagaaacauucuaaccacaaacaauauagcugcgacggcugaauacuauuauaucaaccuaaagacacaaaaacuccacgaguacuacauagagaacuauaacacagcccuagguuauaaaaaauacagcaaagaaauggaauuucugcgaucucuagcauaccgcucggaacguguuaaaauuaaauccauugacgacguaaaacagguacucgacaaagauucaaauuuuauaauaggaaagauaacuuuaccauucaaaaaagaguggcaacgauuauaccgagaauggcaaaauaccacaauaaaagaugauuacgaauucuuaaaauccuuuuucaacgucaaguccaucacuaaacuccacaaaaaagugcgaaaagacuuuaguuuaccaauaucgacuaacgaaggcaaauuuuuaguaaaaagaaaaacaugggauaacaacuucaucuaccaaauccuuaacgacucagacaguagagcggaugguacaaaacccuuuauuccugccuucgauauuaguaaaaacgaaauugucgaagcaauaauagauaguuucacuucgaaaaacauauuuugguuaccaaaaaacauagaacuacaaaaagucgacaacaaaaauauuuucgccaucgauacuagcaaaugguucgaaguagaaacaccaucggacuuaagagacaucggaaucgcaacuauccaauacaaaauagauaacaacucacguccaaagguaagaguaaaacuagauuauguaauagacgacgacaguaagauaaauuacuucaugaaccauucucuuuuaaaaucaagauaucccgauaagguauuggaaauccuaaaacaaucaacaauaauagaauuugaaaguagcggauuuaacaaaacaaucaaagaaauguuagguaugaaacuagccgggauuuauaacgagacaucaaauaauuga

SEQ ID NO: 4862 - RNA, 3162 nt, Artificial Sequence
  Cas9 variant
augaaacgaaacuacauccuaggacuagauauaggcauaaccucuguaggguacggcaucauagacuacgaaacaagggacguaauugaugcagguguccgauuauuuaaagaagcaaacguagaaaauaacgaaggcagaagaucaaaaagaggugccagaagacucaaacgaaggcgacgacaccggauacaaagagucaaaaaauuacucuucgauuauaauuuauuaacagaucacuccgaacuguccggcauaaauccauaugaagcaagagucaaaggacugucccaaaaacuaucagaagaagaauucucagcugcacuacuacaccucgccaaacgacgcgguguacauaacguaaacgaaguagaagaagacacaggaaacgaacuauccacgaaagaacaaaucucacguaacaguaaagcuuuggaagaaaaauacgucgcagagcuucaacuagagagacugaaaaaagacggggaagugaggggaucaauaaauagauucaaaaccagcgauuacguuaaggaagcaaaacaacuacuaaaaguucaaaaggccuaccaccaacuagaucaaucauucauagauacauacauugaccuacuagaaacacguagaacauacuacgagggucccggagaaggaucuccguucggauggaaggacauuaaagaaugguacgaaaugcuaaugggacauuguacauauuuuccagaagaauuacgcucuguaaaauaugcuuacaacgccgacuuauacaacgcuuuaaaugacuuaaauaacuuaguaauaacaagagaugagaacgaaaaacuagaauauuaugaaaaauuccaaaucauugaaaauguauucaagcaaaagaaaaaaccuacauugaaacagauagccaaagaaauucucguaaacgaagaagauaucaaaggcuacagaguaacaucuaccggcaaacccgaauucaccaaucuuaaaguauaccacgauauaaaagacauaacagccagaaaagaaauaaucgaaaacgcagaauuacuagaucaaauagcgaaaauacuaaccauuuaccaguccuccgaggacauacaagaagaauuaacaaaccuaaacucagaauuaacacaagaagagauagaacaaauaucuaaccucaaaggauacacaggaacucauaacuuaagcuuaaaagcaaucaaccuaauacuugacgaacuuuggcacacaaacgacaaucaaauagcaaucuuuaacaggcuaaaacuaguaccaaaaaaaguagacuuaucgcaacaaaaagaaauacccacaacacuagucgaugacuucauucuaucacccguaguaaaaagaucauucauacaaagcauuaaaguuaucaaugccauaaucaaaaaauacggauugccuaaugauauaaucaucgaacuagccagagaaaaaaacagcaaagaugcacaaaaaaugauaaacgaaaugcaaaaacgaaauagacagacgaaugaacgaauagaagaaaucauacguacaacagguaaagaaaaugccaaauaccuaauagaaaaaaucaaauuacacgacaugcaagaaggaaaaugccucuauucccuugaagcuauaccauuagaagacuuacuaaauaaccccuucaauuacgaaguugaucacauaauaccaagaaguguaucauucgacaauucauuuaacaauaaaguucucguaaaacaagaagaaaacagcaaaaaagguaauagaacuccauuccaauauuuauccaguagcgacuccaaaauaucauacgaaacuuuuaaaaaacacauauuaaauuuagcaaagggaaaaggaagaauaagcaaaacaaaaaaagaauacuuauuagaagaaagagacaucaacagauuuucaguccaaaaagacuuuauaaauagaaacuuaguagauacccgcuaugcaacucggggucucaugaaccuuuuaagaucauauuucaggguaaacaacuuagaugucaaaguaaaaucaauuaacggaggauuuacuucuuucuuaagaagaaaauggaaauucaaaaaagaaaggaacaaagguuauaaacaucacgccgaagacgcacuaauaauagcaaacgcagauuucauauucaaagaauggaaaaaauuagacaaagcaaagaaaguaauggaaaaccaaauguuugaagaaaaacaagcagaaucaaugccagagaucgaaacagagcaagaauacaaagaaauauucaucaccccccaucaaauaaagcacauuaaagacuucaaagacuacaaauacucacauagaguagacaaaaaaccaaauagagaacucaucaaugacacauuauacucgacacgaaaagacgacaaaggaaacacccucauuguaaauaaucuaaacggccuauacgacaaagacaacgacaaacuaaaaaaacucauaaacaaaucacccgaaaaauuacucauguaccaccacgacccacaaacauaccaaaaacucaaacugauaauggaacaauacggagacgaaaaaaauccccuuuacaaauacuacgaagaaacaggaaacuacuuaacaaaauauaguaagaaagacaauggacccguaauaaaaaaaauaaaauauuauggcaauaaacugaacgcacauuuagacauaacagaugacuacccaaauaguagaaacaaaguugucaaacuaagcuuaaaaccauacagauucgauguauaccuggacaacggcguauacaaauucguaaccgugaaaaaccuugacgucauaaaaaaagaaaauuacuaugaagugaacucaaaauguuaugaagaagcaaaaaaauuaaaaaaaauuucgaaucaagcggaauucauagccuccuuuuacaacaacgacuuaauaaaaauaaacggagaacucuaucgaguaaucggaguaaauaaugaccuccuaaacagaauugagguaaauaugauagacauuacuuacagagaauaucuagaaaauaugaacgacaaacgcccaccacgaauaauaaaaacaauagcaagcaaaacacaaagcauaaaaaaauacuccacugacauccuuggaaaucuauaugaaguaaaaucuaaaaaacauccacaaauaauaaagaagggauga

SEQ ID NO: 4863 - RNA, 4230 nt, Artificial Sequence
  Cas9 variant
augcuauuuaauaaaugcauaauaaucaguauaaaccuugauuucucuaauaaagaaaaauguaugacgaaaccauauucaauaggcuuagacaucgggacaaauagcguaggaugggcgguaauaacagauaauuauaaaguaccgucgaagaaaaugaaaguauugggaaacacauccaaaaaauacaucaagaaaaaccucuuaggcguuuuacucuucgacuccggaauuacggcagaaggcagacgacuaaagagaaccgcaagaagacguuauacacgaagaagaaaucgaauacuuuaucuacaagaaauauucaguacagaaauggcaacacuugacgaugcauuuuuccagcgccuugacgauaguuuccucguuccagaugacaaacgagauagcaaauauccaaucuuugguaauuuaguagaagaaaaaguuuaucaugaugaguucccaaccauauaucacuuaagaaaauaccuagcugauaguacuaagaaagcagaucuacgucucguauaccuagcacuugcacauaugaucaaguauagaggacacuucuugaucgaaggagaauuuaauuccaaaaacaacgauauucaaaaaaacuuccaagauuuccuagacaccuauaacgcaauuuucgaaucagaccugagccuagaaaacucaaaacaauuagaagagauagugaaagauaaaaucucaaaauuggaaaaaaaagaccgaauacuaaaacuauucccaggagaaaagaacucaggaauauucuccgaauuucuuaaacuuauagugggaaaucaagcggauuuucgaaaaugcuuuaacuuagacgaaaaagcaagucuacacuuuucgaaagaaucauaugacgaagaccuagagacauuacuagguuauauaggugaugacuauuccgacguauucuugaaagcaaaaaaauuauaugaugcaauuuuauuaaguggguuccugaccguaacagauaaugaaacagaagcaccacuuaguucagccaugauuaaaagauacaacgagcacaaggaagaucuagcccuacuaaaagaauacaucagaaacauauccuuaaaaacuuauaaugaaguauucaaagaugauaccaaaaacggauaugccggcuacaucgauggcaaaacgaaccaagaagacuucuacguuuauuuaaaaaaccuauuagcggaauuugaaggagccgacuacuuucuagaaaaaauagauagagaggauuucuuaagaaagcaacgcacauucgauaaugggaguaucccauaccaaauucauuuacaagaaaugagggcaauacuagacaaacaagcuaaauucuacccauuuuuggcuaagaauaaagaacguauagaaaaaauacuuacauucaggauaccauacuauguaggcccauuagccagaggaaauagugauuucgccuggucaauaagaaaaaggaacgaaaaaaucacaccauggaacuuugaagaugucauugauaaagaaucaagugccgaggcauucaucaauagaaugacaucauuugaucuauaucuucccgaagaaaaaguacuacccaaacauagucuauuauaugaaacuuuuaauguauacaacgaacuaacuaaaguuagauucaucgcagaaucaaugagagauuaucaauuccuagacucaaaacaaaaaaaagauaucgucagauuauacuuuaaagacaaaagaaaaguuacagacaaagacaucaucgaauaccuucacgcaauuuacggauacgauggaauagaacuuaaaggaauagaaaaacaguuuaacucaagucuuaguaccuaucaugauuuauuaaacaucauaaaugacaaagaauuccuagacgacucaucaaacgaagcaauaauagaggaaauaauccacacacuaaccauauuugaagacagagaaaugauaaaacaacggcuaucuaaauuugaaaauaucuuugacaaauccguacuaaaaaaacuaucacgaaggcauuauacaggauggggcaaacuguccgcuaaacuuauaaacggaauaagagaugagaaaucaggaaacacaauauuagacuaucuaauugacgauggaauuaguaaucgaaauuucaugcaauuaauacacgacgacgcccuaaguuucaaaaaaaaaauacaaaaggcacaaauaauaggugaugaagacaaaggaaauauuaaagaagucguuaagucccuaccuggaagucccgcaaucaaaaaaggaauucuucaaagcaucaaaauaguugacgaacucguaaaaguuaugggaggacgaaaacccgagucaaucguggucgaaauggcuagagaaaaucaauacacaaaucaaggaaaaaguaacucacaacaacgauuaaaaagguuagaaaaaucgcucaaagaauuaggaucaaaaaucuuaaaagaaaauauaccagccaaacucucaaaaauagauaauaacgccuuacagaacgacagauuauaucuauacuaccugcaaaacggaaaagacauguauacuggagaugaccuagacauugacagauuaucuaacuaugacauugaccacaucauaccacaagcauucuuaaaagacaauucaaucgacaacaaaguacucguuaguucagccagcaaucgaggaaaaucggacgauuucccaagcuuagagguaguuaaaaaaagaaaaacguucugguaucaacuauuaaaauccaaauuaauuagccaacgcaaauucgacaaccugacaaaagcagaaaggggcggacuacuuccagaagacaaggcaggcuuuauacaaagacagcuuguagaaacaaggcaaaucacaaagcacguggcaagacuucuagacgaaaaauuuaacaauaaaaaagacgagaauaauagagcagucagaacuguaaaaauaaucacccucaaauccacauugguaagccaguuucgaaaagauuuugagcucuauaaaguaagagaaauaaacgacuuccaccacgcacacgacgccuauuuaaaugccgucauagccuccgcauuacuuaagaaauacccaaaauuagaaccagaguuuguauauggagacuacccaaaauacaauucauuuagagaacgaaagucagcgacugagaaagucuauuuuuacucaaacauuaugaacauauucaaaaaauccauaucucuugcagauggaagaguuaucgaacgcccccuaauagaaguaaacgaggaaacaggagaauccgucuggaacaaagaauccgauuuagcaaccguaagaagaguguugagcuacccccaaguuaauguaguaaaaaagguagaagaacaaaaucacggacucgacagaggcaaacccaaaggacuauucaacgcaaaucugaguaguaagccaaaaccaaacucuaaugagaaccucguaggagcuaaagaguaucucgacccaaaaaaauacgguggauaugccgguauuagcaacaguuuugcuguuuuaguaaaagggacuauagaaaagggagcaaaaaaaaaaaucacuaacguauuagaauuucaagguauaucaauauuagacaggauaaacuaccgaaaggacaaauuaaacuuccugcuagaaaaaggauacaaagauauugaacuuauaauagaacuaccaaaauauagucuguuugaauuaucagacggcucacgacgcaugcucgcaagcauauuaucaaccaacaauaaacgaggugaaauccauaaaggcaaccaaaucuuccugucccaaaaguuuguaaaacuucucuaccaugcgaaaagaauaucaaacacaauaaacgaaaaucauagaaaauacguagaaaaucacaaaaaagaauuugaagaacuuuucuauuauauacucgaauuuaacgagaacuauguaggugcaaaaaaaaacggaaaauuacuaaacagcgcuuuccaaagcuggcaaaaccacucaaucgaugaacuaugcuccuccuuuauaggaccuacagguucagaaagaaagggucuuuucgaauuaaccucccgugguucggcagcagauuuugaauuccuuggaguuaaaauaccacgcuaccgugauuauacuccaucaagccuucuuaaagacgcaacacucauacaucaauccguuacaggauuauacgaaacacgaauagaccuagcaaaacuaggggaaggauga

SEQ ID NO: 4864 - RNA, 3306 nt, Artificial Sequence
  Cas9 variant
augugguaugccucauuaauguccgcacaucauuugagaguggguauugauguagguacucacaguguuggacuagcaacacugagaguagaugaccauggaacaccaauagaauuacucucagcuuuaucgcauauacacgacucaggaguagguaaggaaggcaagaaagaccaugacacaaggaagaaacuaagugggauagcaagacgagcaagacgucuauugcaccacagaagaacccaacuccagcaacucgaugaaguauuaagagacuugggauuuccaauaccuacaccaggugaauuuuuagaucuaaaugaacaaacagauccuuacagaguauggagaguaagagcacgauuagucgaagaaaaacuaccugaagaacucagaggcccggcuauaucaauggcuguuagacauauugcaagacacagaggauggagaaauccauauucgaaaguugaaucauuacuuaguccugcugaagaaagcccuuuuaugaaagcauuaagagagagaauauuagcaacuaccggagaaguauuagaugacggaauaacgcccggucaagcaauggcccagguagcauuaacucacaauauaaguaugagagguccugaagguauauuagguaaauuacaccaaagugacaaugccaacgaaauacgaaaaauaugugcaagacaaggaguauccccugacgucugcaaacaacuauugcgagcaguauucaaagcagauucuccccgaggaucagcagucucaagaguugccccggacccauuacccggacaaggaucauuuagacgagccccaaaaugugacccagaauuucaaagauuuagaauuauaaguauaguagcaaacuuaagaauaucggaaacgaaaggagaaaauagaccucuuaccgcugaugaaaggaggcauguaguuacuuucuugacagaagauucucaagcggaccucacauggguugauguagcugaaaaauuaggaguacacagaagagaccuucgaggaacagcaguacauacagaugacggagagagaucugcagccagaccaccaauagaugccacggacagaauaaugagacaaacaaaaauaucaucacuuaaaacauggugggaagaagcagacagugaacaaagaggagcaaugauaagauauuuauacgaagauccgacagauagugagugugcugaaauaauagcagaacuaccagaggaagaucaggccaaauuagauuccuugcaucuaccugcggguagagcugcauacucaagagaaaguuugacugcucuaucagaucacauguuagcuacuacagaugaccuccacgaagcaagaaaacgacuauuuggagucgaugacagcugggcaccacccgcugaagcaauaaaugcacccguagguaauccaucgguagauaggacuuuaaaaauaguuggacgauaccuaucagcaguugaaagcauguggggaacuccugagguuauccauguagaacacguacgagauggauuuacaagugaaagaauggccgaugaaagagacaaggcaaaucgacgaagguacaacgacaaccaggaggcgaugaagaaaauucaacgagauuacggaaaagaaggauacaucagccgaggagacauaguaagacuugacgcuuuagaauuacaagguugugcaugucuauauugugguacuacaauuggauaucauacaugucaauuagaucacauuguuccacaagcaggcccaggaucaaauaauagaagaggcaauuuaguagcaguaugcgaaagauguaauaggucuaaaucaaacacaccuuuugcaguuugggcacaaaaauguggaauaccacacguagggguuaaggaagcaauaggaagaguaagagguuggaggaaacaaacuccaaauacuucaagugaggauuuaacgagauuaaagaaagaaguaauugcuagauuaagacgaacacaagaagauccagaaauagaugaacguagcauggaaucgguagcuuggauggcgaaugaauuacaccauaggauagcggcagcauacccagaaacaacuguuaugguuuacagaggaaguauuacagccgcagcuagaaaagcagccggaauagauuccaggauaaaucuaauaggagagaaggguagaaaagauagaauugaucgaaggcaucaugccguggacgcuucaguaguugcauuaauggaggcuagcguagcaaaaacucuagcggagcgaucaucacuacgcggugaacaaagacugacgggaaaagaacaaacauggaaacaauauacaggcaguacuguaggugcucgagaacacuuugaaauguggagaggacacaugcuucauuuaacagaacuauuuaacgaacgucuagcagaagauaagguauacgucacacaaaauauaagacuacgcuuaagugauggaaacgcucauacgguaaaucccaguaaauuaguaucacauagauuaggagauggguuaacaguacaacaaauagauagagcguguacaccagcauuguggugugcgcuuacgagagaaaaagacuuugacgagaaaaacggacuaccagcgcgagaagauagagcuauacgcguccacggacacgaaauaaagucaagcgauuacauacaaguuuucaguaaaaggaagaaaaccgauucagauagagaugaaacaccauucggagccauagcaguucguggaggguuuguugaaauaggaccaagcauucaucacgcuaggauauaucgaguugagggaaagaaaccaguauaugcaaugcuaagaguauuuacccaugaccuacugucacaaaggcacggagauuuauuuuccgcagugauaccaccucaaucaauaagcaugagaugugcagaaccaaaacuuagaaaagccauaacuacgggaaaugcaacauacuuaggcugggucgugguuggugacgaauuggaaaucaauguugacaguuuuacgaaauaugccauuggccgauuuuuagaagauuucccaaauacuacaagauggcgaauuugcggguaugauacaaauucuaaauuaacgcuaaaaccuauaguucucgcagcugaaggguuagagaacccauccucagcagucaaugaaauuguagaacuuaaaggauggaggguugcaauuaauguauuaacaaagguacauccuacaguaguaagaagagaugcccucggacgaccucgcuauucuagcagaucaaaccuacccacaucguggacaauagaauga

SEQ ID NO: 4865 - RNA, 4167 nt, Artificial Sequence
  Cas9 variant
augacuaaaccauauagcaucggauuggacauaggcacaaacaguguaggaugggcaguaacaaccgacaauuacaaaguuccaagcaaaaaaaugaaagucuuaggcaacacuucaaaaaaguacauaaaaaaaaauuuacuaggcguauuacucuucgauucggguauaacagcugaaggaagacgacuaaaaagaacagcacgaagaagauacacgcguagaagaaaccgaauauuauauuuacaagaaaucuucucaacagaaauggcaacacuagaugacgccuuuuuccaacggcuagacgacucuuuucuaguaccugacgauaagcgagacuccaaauauccuauauucggcaauuuaguagaagagaaggcauaccaugacgaauuuccuacuaucuaucacuuaagaaaauaucuagcggacucgacaaaaaaagccgacuuacgauuaguuuaccuagcuuuagcacacaugaucaaauacagaggucauuuucuuauagaaggugaauuuaacagcaaaaauaaugacauacagaaaaacuuccaagauuuccuugauaccuauaaugcaaucuucgaaagcgaccuuaguuuagaaaauucuaagcaauuagaagaaauuguaaaagauaaaauuucuaaacucgaaaaaaaagauagaauacuaaaacuuuucccgggagaaaaaaacucaggaauauucucggaauucuuaaaauugaucguaggcaaucaagccgauuucagaaaguguuucaaucucgacgagaaagcgagcuuacauuucaguaaagaaucuuacgacgaagaucuugagacccuucuaggauauaucggugaugacuacuccgacguauuucuuaaagcaaaaaaguuauacgaugcuauacuucuaucagguuuucuaacaguaacugauaaugaaacagaagcuccacuuucaagugccaugauaaaaagauauaacgaacauaaagaagaccucgcuuuacucaaagaauauauccgcaacauaucacugaaaacauacaacgaaguguuuaaagacgauacuaaaaacgguuacgcagguuauauagauggaaaaacuaaucaagaagacuuuuacguguauuuaaaaaaauuauuagcagaguucgaaggugcugauuacuuccuugaaaaaauagacagagaagacuuuuuaagaaaacagcgaacguucgauaacggauccaucccauaccaaauccaccugcaagaaaugcgugcaauucuggauaaacaagccaaauuuuauccuuuccuagcuaaaaacaaggaacgcauagaaaaaauccuuacuuuccgaaucccauacuacguaggcccauuggcaagaggcaacagcgacuuugccuggucaauucgaaaacgcaacgaaaaaauuacaccauggaauuuugaggauguaaucgauaaagaaucaucagcagaagccuuuaucaauaggaugacauccuuugaucuuuaucugccagaagaaaaaguacuaccaaagcauucauuacuguacgaaacauuuaacguuuacaaugaacugacaaaaguaagauucauagcagaaucgaugagagacuaccaguucuuagauuccaaacaaaaaaaggauauaguucgacuuuacuuuaaagauaaaagaaaagucacagauaaagauauaauagaguacuuacacgccauauauggauaugauggaauagagcuaaaagguauagaaaaacaauucaacagcucacuauccacauaucaugacuuacuaaauauaauaaacgauaaagaauucuuagacgacagcucuaaugaagccauaauagaggagauaauucacacacuuacuauauuugaagacagggaaaugauaaaacaaagacuguccaaauucgaaaauaucuucgauaaaucaguauuaaaaaaacuuucucgacgacacuacacagguuggggaaaacuauccgccaaauuaauaaacggaauaagagaugaaaagaguggaaacacaauacuugacuacuugauagaugauggaaucucaaauaggaauuucaugcaauuaauacaugaugaugcauuaucauucaaaaaaaaaauacaaaaagcgcaaauuauaggugacgaagauaaaggaaacauaaaagaaguuguuaaaagccuuccaggcucaccagcaaucaagaaaggaauccuucaaucaaucaaaauagucgaugaauuaguuaaggucaugggagguagaaaaccagaaucgauagucguggaaauggcacgagaaaaucaauauacaaaucaaggcaaaucuaacagccagcagagacuaaaaagacuugaaaaaagucucaaagaacuaggcagcaaaauacuaaaagaaaacauacccgcaaaacuaucgaaaauagacaacaacgcacuucaaaacgaucgcuuguaucuauacuauuuacaaaacgggaaggacauguacacuggggacgaccucgauauugaccgacucucaaacuacgauauugaucacauaauuccacaagcauuccuaaaagacaauucaauagauaauaaaguacuaguaagcagugcuaguaaucgaggaaaaucagaugacgucccuucucucgagguagucaagaaaagaaaaacauucugguaucaacuucuuaaaagcaaacucauaucacaaagaaaguuugauaaucucacuaaagcagaacguggaggauuaucaccagaagauaaagcagguuuuauacaaaggcaacucguagaaacaagacaaauuacaaagcauguagcacguuuguuagacgaaaaauucaacaauaaaaaagacgaaaacaaccgcgcaguacgcacaguaaaaaucauuacuuuaaagagcacacucguaucccaauuuagaaaagauuuugaacucuauaaaguccgagaaauaaacgauuuucaccaugcucacgacgcguauuugaaugcuguaguagcaagugcucuacugaaaaaauauccuaaacuagaacccgaauucguauacggagacuauccaaaauacaacuccuuccgagaaagaaagagcgccacagaaaaaguauacuucuauucaaacauaaugaacauauuuaaaaaaaguauaagucuagcagauggucgcguuauagaaaggccauuaauagaagugaacgaagaaaccggagagucaguauggaacaaagaaagcgacuuagcaacaguuagacgaguauuaucauauccacaagugaacguuguaaagaaagucgaagagcaaaaucacggauuagaucgagguaaacccaaaggucuguuuaaugcaaacuuaucaucaaaaccaaaaccaaacucaaacgaaaaccuagucggagcaaaagaauacuuagacccaaaaaaauacggaggcuacgccgguauaucaaauaguuuuacgguucuuguaaaagguacaaucgaaaaaggagcuaaaaaaaaaauaaccaauguacuugaauuucaagggauaucaauucucgaucgcauaaauuaucgcaaagauaaauuaaacuucuuacuagaaaaaggauauaaagacauagaauuaauaaucgaacuucccaaauacucacuguucgaacuaucagacggaucaagaagaaugcuagcgaguauacuaucaacuaacaacaaaagaggagaaauccauaaagguaaccaaaucuuucuaucccaaaaauuugucaaacuauuauaucacgcaaaaagaauaucaaacacuaucaacgaaaaccaucgaaaauaugucgaaaaccacaaaaaggaauucgaagaauuguucuacuauauccuugaauuuaacgaaaacuacguaggcgcaaaaaaaaaugguaaacuauugaacucugcauuucaaagcuggcaaaaccauaguauagacgaacuuugcucuucauucauagguccaacagguucugaacguaaaggauuauuugaacuuaccucuagagggucagcagcugauuuugaauuucuaggcguuaaaauacccagauaccgagauuauacgccgucauccuuacugaaagacgcaacacuaauccaucaaaguguaacaggauuguacgaaacgcgcauagaucuugcaaaauuaggggaaggauga

SEQ ID NO: 4866 - RNA, 3249 nt, Artificial Sequence
  Cas9 variant
auggccgcguuuaaaccaaacucaauuaauuauauauuaggauuagauaucggaauugccucuguagguugggcgaugguugaaaucgacgaagaagaaaaucccauaagauuaauagauuuaggaguacguguauucgagcgagcagaaguaccaaaaaccggcgacucauuagcaauggcaagaagauuagcucgaucuguaagaagacuaacaagaaggagagcccauagacuguuaagaacaaggcgacuuuuaaaacgugaagguguacuccaagcugccaacuuugacgaaaacgggcuaauuaaaagccuuccaaacacacccuggcaacuaagggcagcugccuuagauagaaaacuaacacccuuagaauggucggcaguucuauuacaccugauaaaacauagaggguauuuaucacaaaggaaaaaugaaggugagaccgcagauaaagaacuuggagcauuguuaaaaggaguagcggguaaugcacaugcuuuacaaacaggugacuuuagaacccccgcagaacuagcacucaacaaauucgaaaaagaaucaggacacauuagaaaccaaagaucugacuacucacauacauuuucaaggaaagauuuacaagcagaauuaauccuauuguucgaaaaacaaaaagaguucggaaacccucacguaucaggaggucuaaaagaaggaauagaaacacuccuaaugacgcaaagaccagcgcucuccggagaugccguacagaaaauguuaggacacugcacuuucgaaccugcagaaccgaaagcugcgaaaaacacauauacagcagaacgcuuuauauggcucacaaaacuuaacaauuugagaaucuuagaacaagguucagaaagaccacugacagacacagagcgagcuaccuuaauggacgaaccguaucgaaagagcaaauuaaccuacgcacaagcaagaaaauuguuaggauuagaagauacagcauucuuuaaaggauuacgauauggaaaagacaacgcagaagccucgaccuuaauggaaaugaaagcguaccacgcaaucucgagagcuuuagaaaaagaaggucuaaaagauaagaaauccccacuaaacuuaucaccggaacuacaagaugaaauaggaacagcauuuucacucuuuaaaacagaugaagacauaacaggaagacuaaaagauagaauacaaccagaaauauuagaggcuuuacuaaaacauauaucauuugauaaauuuguacaaauaucauugaaggcuuugagaagaauuguaccuuuaauggaacaaggaaaaagauacgacgaagccugcgcugaaauauauggagaccauuauggaaagaaaaacacagaagagaaaauauacuuaccuccaauaccagcugaugagauuagaaacccaguaguacuuagagcacuuucgcaagcucgaaaagugauuaacggcguaguaagaagauacggcuccccggcuagaauacauauagagacagcaagggaaguuggcaaaaguuuuaaagaccguaaagaaauagagaaaagacaggaagaaaacaggaaagaccgagaaaaagcagcugcaaaauucagagaauauuuuccaaacuuuguaggagaaccaaaaucaaaagauauauuaaaacugagacuauaugaacaacaacauggcaaaugucuauacucaggaaaagaaauaaaccuuggaagacugaaugaaaaaggauauguggagaucgaucaugcgcuaccauucagccgaacaugggacgauucauucaauaauaaagugcuaguacuaggauccgaaaaucaaaauaaaggcaaucaaacgccguaugaguauuuuaacgggaaagacaacucaagagaauggcaagaauuuaaagcaaggguugaaaccagcagguucccucgaagcaagaaacaaagaauauuauuacagaaauucgacgaagacggauuuaaagaaagaaaccuuaaugauacaagauauguaaacagguuucucugucaauuuguagcagauaggaugagauuaacugggaaagguaagaaacgcguauucgcaucaaaugggcaaauaacaaaucuacuaagaggauuuuggggacuacgaaaaguaagagccgaaaacgacagacaucacgcucuagaugcaguagugguugcauguaguacggucgcaaugcagcagaaaauaacuagauucgugagauauaaagaaaugaaugccuuugauggaaaaacaauagacaaagaaaccggagaaguccuacaucagaaaacgcacuucccacaaccuugggaauuuuucgcucaagaaguuaugauacgaguauuugguaaaccagacggcaaaccagaguucgaagaagcugauacccuugaaaaauuacguacccuauuagcagagaaacuaagcagcagacccgaagcaguacacgaauaugugacuccgcuauuuguaaguagggcaccaaauagaaaaaugucuggucaagggcauauggaaacugucaaaucagcaaaaagacuagaugagggagucucagucuuaagaguacccuuaacacaauuaaaauuaaaagacuuagagaaaaugguaaaucgagaaagagaaccaaaacuauaugaagcacugaaagcuagacuugaagcacacaaagaugacccagcgaaagcauucgcagaaccauuuuauaaauacgauaaagccggcaauagaacccaacaaguuaaagcaguacgaguugaacaagugcagaaaacugggguauggguccgcaaucacaauggaauagcagauaacgcuacaauggucagaguagauguauucgaaaaaggggacaaauauuacuuaguaccaauauauuccuggcaagucgccaaaggaauacuuccugaccgggcuguaguucaaggaaaagaugaagaagauuggcaauugauagaugacagcuuuaacuucaaauucagccuacacccaaacgaccucguugaagugaucacaaagaaagcaagaauguucgguuauuucgcaaguugucaccgugguacagggaacauuaauauaagaauacacgauuuagaccacaaaaucgggaaaaacggaauacucgaaggaaucggaguaaaaaccgcuuugucuuuucaaaaauaccaaauugaugaauuaggaaaagaaauuagaccauguagacuaaagaaacguccaccaguuagguga

SEQ ID NO: 4867 - RNA, 4005 nt, Artificial Sequence
  Cas9 variant
augaaaaagccuuacaccauuggacuagacauuggaacaaacagcguuggcugggccguauuaacugaucaauaugaucuagucaaacguaaaaugaaaauagccggagauuccgaaaagaaacaaaucaagaaaaauuuuugggguguacgacuauuugacgaaggacaaacggcagccgaccgcagaauggccaggacggccaggagaagaauagaaagacgacguaaccgcauaucauaccuccaaggaauauucgcagaagaaaugucuaaaaccgaugccaacuucuuuugccgcuuaagcgauucauuuuacguagacaaugagaaaagaaacucccgucauccuuucuuugccacaauagaagaagaaguagaauaucauaaaaauuacccuacaauuuaucaucuaagagaagaacugguuaacuccagcgaaaaagcagaccuaagauuagucuaccucgcgcucgcgcauauaauuaaauauagaggaaacuuuuuaauagaaggagcuuuagauacacaaaauacgaguguggaugguauauacaaacaauuuauccagacguauaaucaaguauuugcuaguggaaucgaagacggcucacuuaagaaacucgaagacaauaaagauguagccaaaauucuagucgagaaagucacgaggaaagaaaaacuagaaagaauacucaaauuauacccaggggagaaaagcgcuggaauguuugcacaauuuauaucucucauaguaggaagcaaagguaauuuucaaaaaccauuugauuuaauagaaaaaucggauaucgaaugugcaaaagauagcuaugaagaagaucucgaaucacucuuggcguugauuggcgacgaauacgcagaacuguuugucgcagccaaaaaugcauacagcgcagucguccucucaaguauaauaaccguagcagaaaccgaaacuaaugcaaaacuguccgcaucaaugauagaaagauucgauacgcaugaggaagaucuaggugaauuaaaagccuuuauaaaauugcacuuaccaaaacacuaugaagaaauauuuagcaauaccgaaaaacacgguuacgcaggauacaucgauggcaaaacaaaacaagcagauuucuacaaauacaugaagaugacacuagaaaacauagaaggugcagacuacuucauagcaaagauagagaaggaaaacuuccucagaaagcaacguacuuuugauaauggugcuaucccacaccaauuacacuuagaagaacuagaggcaauauuacaccaacaagcuaaauacuauccguuucucaaagaaaacuaugacaaaauaaaaucauuaguaacauuuaggauuccauauuucguuggacccuuggcaaacggacaauccgaguucgcauggcuaacuaggaaagcggacggggaaauccgacccuggaauauugaagaaaaaguagacuucgguaaaagugcaguagauuucauagagaaaaugacaaacaaagauacauaucuaccaaaagaaaacguuuuaccaaaacauaguuuauguuaccaaaaauaccuaguauauaaugaacucacaaaaguuagguauauuaacgaccaagguaaaacaucguauuuuagcggacaagaaaaagaacaaauauucaaugaccuauucaaacaaaaacgaaaaguaaagaagaaagaucucgaacuauucuuaagaaauaugagucacguagaaucaccaacuauagaaggacuagaagacaguuuuaauuccuccuauaguacauaccaugaucuacucaaaguagggauaaaacaagaaauuuuagacaacccaguaaauacagaaauguuagaaaauaucgucaaaaucuuaacaguauuugaagauaaacgaaugauaaaagaacaacuccagcaauuuuccgauguacucgacggugucgucuuaaagaaacuugaaagaagacauuauaccggauggggacgauuaucagcaaaacuauuaaugggcauucgagacaaacagagccaccuaacaaucuuggauuaccuaaugaaugacgauggacucaaccgaaauuugaugcaacucauaaacgauaguaacuuaucuuucaaaucaaucauagaaaaagaacaagucacaacugcagacaaagauauccagagcauagucgcugaucuagccgguucacccgcuauuaagaaaggcauauugcaaucauuaaaaauaguggacgaauuaguaucagucaugggcuacccaccgcaaacaauugucguagaaauggcuagagaaaaucaaacaacaggaaaaggcaaaaauaauagcagaccuagauacaaaucacuugaaaaagccauaaaagaguucggcucucagauauuaaaagaacaucccacagauaaucaggaacugaggaacaauagauuauaucuauauuacuugcagaaugguaaagauauguacacuggacaagaccuugacauacacaauuuaucaaauuacgauaucgaccacauagugccccaaaguuuuauuacugacaauucgauugacaaucuaguacucacaucaucagcuggaaauagggaaaaaggcgaugauguaccaccacuagaaaucguacgaaaacgaaaaguauuuugggaaaaauuauaccaaggcaauuuaaugaguaaaagaaaauucgacuaucuuacaaaagcugaacgaggaggacucacugaagccgacaaagcaagauuuauacacagacaauuaguagaaacgcggcagauaacuaaaaacguagcuaacauacuacaccaaagauucaacuacgaaaaggacgaccacggaaacacaaugaaacaaguaaggauagugacauuaaaauccgcgcuaguaagccaauucagaaaacaguuucaacuauacaaaguuagagacguaaaugauuaucaucaugcucaugaugcguaccucaacggcguuguggcaaauacauuauuaaaaguguauccacaauuagaaccagaauuuguuuacggagauuaccaucaauucgacugguuuaaagcaaauaaggcuacagcgaagaaacaauucuacacuaauauuaugcuauucuucgcacaaaaagauagaaucauagaugaaaauggagaaauucuuugggacaagaaauaccucgauacaguuaagaaaguaaugucauacagacaaaugaacauagucaagaaaacggaaauucaaaaaggagaguucucgaaagcaaccauaaaaccgaaaggaaauuccagcaaacucauacccagaaaaacaaauugggauccaaugaaauacggaggcuuagacucgccaaauauggcauaugccguagucauagaauacgcuaaagguaaaaacaaauuaguauucgaaaagaaaauaauuagagucacaauaauggaaagaaaagcauucgaaaaagacgaaaaagcguuucuagaagaacagggauauagacagcccaaaguauuagcaaaacuaccuaaauauacguuauacgaaugugaagaaggaagaaggagaaugcuggcaucugccaacgaagcucaaaaaggaaaccaacaaguauuaccuaaucauuuaguaacacuucuacaucaugcggccaacugcgaaguuucggacggaaaaagucuagacuacauagaaucaaacagagaaauguuugcggaauuacuagcucacguuagugaguucgcaaaacguuacacuuuagcugaagcaaacuuaaacaaaauaaaccaauuauucgaacagaauaaagaaggcgauauuaaagccauagcucaaaguuuuguagaucuuauggcuuuuaaugcaaugggggcaccagccucauucaaauuuuucgaaacuaccauugaaaggaaaagauauaacaaucuuaaagaacuacucaacucaacaauaauauaccaaucaaucacaggauuauaugaaucacgaaaaagauuagaugacuga

SEQ ID NO: 4868 - RNA, 4038 nt, Artificial Sequence
  Cas9 variant
augaaaaaaccauacucgauugggcuugacauagguacaaauucagucggcugggcagucguaacggaugacuacaagguuccagccaaaaaaaugaaagugcuaggcaauacagacaaaucacauauagaaaaaaaccuuuugggcgcacuauuauucgacucaggaaauacagccgaagaccgucgacuaaaaaggacagcccguagaagauauacaagacgaagaaacagaaucuuauacuuacaagaaauauuuucugaagaaaugggaaaaguugaugauucauucuuccaccgacuagaagacagcuucuugguaacugaagacaaacgaggagagagacacccaauauucggcaaccucgaagaagaagucaaauaucacgaaaauuuucccacaauauaucauuuacgucaguauuuagcggauaacccugaaaaaguagauuuacgcuuaguauaccucgcacuagcccacaucauaaaguucagaggacacuuucuuauugagggcaaauucgacacaaggaacaaugacguucaacgacuauuccaagaauuuuuagcaguguacgauaacaccuucgagaauagcucccuccaagaacaaaacguucaagucgaagaaauacuaaccgauaaaaucucaaaauccgcaaaaaaagauagaguacugaaacuauucccgaaugaaaaaagcaauggacgauuugcagaauuuuugaaacuaaucguaggcaaccaagccgacuuuaaaaaacacuuugaauuagaagaaaaagcuccauuacaauuuaguaaagacacauacgaagaagaacucgaaguauuauuggcucaaauuggugauaacuacgcagaacuauuucuaucugcaaaaaaauuauaugacucuauucuacuaucaggcauacuuacuguuacagacguaggaacgaaagcgccauuauccgcgagcaugauacaacguuauaacgaacaccagauggacuuggcacagcuaaaacaauuuauucgacaaaaauugagugacaaauacaacgaaguguuuagcgacguaucaaaagacgguuaugcagguuacauagaugguaaaacaaaucaggaagcauucuacaaauacuuaaaaggccuacuaaacaaaauagagggaucaggauauuuccuagacaaaauagaaagagaggauuuccuucguaaacaaagaacauucgacaauggaucuauaccacaccaaauacaccugcaagagaugagagcaauuauacggcgccaagcagaauuuuaccccuucuuagccgauaaucaagauagaaucgaaaaacuauuaacauucagaaucccauacuacguaggaccguuagcacgaggaaaaagcgauuuugcaugguuaucuagaaaguccgccgauaaaaucacacccuggaacuuugaugaaaucguagacaaagaaucaucggcagaagccuucauuaaccggaugacaaauuaugacuuauauuuaccaaaccaaaaaguccuacccaaacacuccuuauuauaugagaaauuuaccguauauaacgaacucacaaaagucaaauauaaaacagaacaaggaaagacagcuuuuuuugaugcgaauaugaagcaagaaauauuugauggcgucuucaaaguauaccgaaaaguaacuaaagauaaauuaauggacuuccuagagaaggaauucgaugaauuuagaauuguagaccuaacggggcuagacaaagaaaauaaggucuucaacgcaagcuauggcaccuaucaugaucuuuguaaaauauuggacaaagauuuuuuagauaauucaaagaaugaaaaaauacuggaagacauaguauuaacacuuacccuuuuugaagaucgcgagaugauaagaaaaagauuagaaaacuacagugaucuccuaacaaaagaacaaguaaaaaaauuagaaagaaggcacuacaccggauggggaagacuaucugcggaauuaauacauggaauuagaaacaaagaaagcagaaaaacuauacuagauuaccuaaucgacgacgguaauagcaauagaaauuucaugcaacuaauaaacgacgacgcacuauccuuuaaagaagaaauagcuaaagcucagguaauaggcgaaacugauaacuuaaaucaaguaguaucugacauagccggcagcccagcaauaaaaaaggguauccuucaaucuuuaaaaaucgucgaugaacuaguaaagauuaugggccaccaaccagaaaacauagucguagagauggcacgcgaaaaccaauuuacgaaccaaggaagaagaaauucacaacaacgacuuaagggauuaaccgauucuauaaaagaauuugggucacaaauauugaaagaacauccaguagaaaauucacaauuacaaaacgaccgacuauuucuuuauuaucuucaaaauggacgugauauguacaccggugaagaacuugauauagacuaucuaagccaauaugacauugaccacauaauuccacaagcuuuuauaaaagauaauuccauagauaauaggguacucacgucaucaaaagaaaacagaggaaaaucagaugauguuccuagcaaagauguuguaaggaaaaugaaaagcuacuggucaaagcuccuaucugcaaaauuaauaacacaaagaaaauucgacaaccuuacaaaagcggaacgaggaggccucacagacgacgacaaagcaggauucaucaaaaggcaacuaguagaaacuagacaaaucacaaaacacguagcuagaauauuagacgaacgauuuaacaccgaaacugacgaaaauaacaagaaaaucaggcaagucaaaauagucacauugaaaucaaaccucgucuccaacuuuagaaaagaauucgaacuuuauaaaguacgagaaauaaacgauuaccaucacgcacacgacgcauaccuuaaugcaguaauaggaaaagccuuacuagguguauacccccaacuagagccagaguuuguauacggcgacuacccacacuuucauggccacaaagaaaacaaagcaacugcaaaaaaauucuucuauaguaacauaaugaauuuuuuuaaaaaagacgacguccggaccgauaagaauggcgaaauaauauggaagaaagaugaacacauaaguaacauaaaaaaaguacuuuccuacccucaaguaaacaucguuaaaaaaguagaagagcaaacgggaggcuucaguaaagaaagcauauuaccaaaaggaaauucugacaaacuaaucccaagaaaaacuaaaaaauucuauugggacacaaaaaaguacgggggauuugacuccccuaucguagcauauucaauccuaguaauugcagauaucgaaaaaggaaagucgaaaaaacuaaaaacaguaaaagcuuugguagggguaacaauuauggaaaaaaugaccuuugaaagagauccaguggcuuuccuagaaagaaaagguuacagaaacguacaagaagagaacauuauaaaacucccaaaauacagccuauuuaaacuugaaaacggaagaaaaaggcuacuggcaucggcucgagaacugcagaagggaaacgaaauagugcuaccaaaucauuuaggaaccuugcuauaucacgcaaaaaauauccauaaggucgaugaaccgaaacacuuagauuacguagauaaacauaaagaugaauucaaagaacuccuagaugugguaaguaauuuuagcaaaaaauauacccuugcagagggaaaccuagaaaaaauaaaagaacucuaugcucaaaacaacggcgaagauuuaaaagaacuagcuucaucauucauuaaucuacuaacauucacagcaaucggugccccagcaacauuuaaauuuuuugacaaaaacaucgacagaaaacgauauacaucuacaacggaaauacucaaugcaacacuaauccaucaaucaauuacuggccucuacgaaacucgaauugaccuuaauaaacucggaggcgauuga

SEQ ID NO: 4869 - RNA, 3171 nt, Artificial Sequence
  Cas9 variant
augcaaacuacaaaccugucguacauauuagggcuagaccuaggaaucgcuagcguaggcugggcugucguagaaauaaaugaaaaugaagacccaauaggacuaaucgacguaggugugcgaaucuucgaaagagcagaaguuccuaaaacaggagaaucgcuagcacucucacgucgacuugccagauccacccguagguugauacguagacgugcacacagacuacuauuagcgaaaagauuucuaaaaagagaaggcauacuuuccacaauagaucucgaaaagggauuaccuaaucaggcuugggaacuuagaguagcaggacuugaacgucgauuaagugcaauugaauggggagcaguacuauugcaccuaauaaaacauagaggcuaucucucaaaaagaaagaaugaaagccaaacgaacaauaaagaacuaggagcauugcuaagcgguguagcucaaaaccaucaacuacugcaaagcgaugauuacagaacaccagccgaauuagcacuaaagaaauucgcaaaagaagaaggccauaucagaaaccaacgaggggcauauacgcacacuuucaacagacuagauuuacucgcugaauugaaccuauuauucgcacaacaacaucaauuuggcaauccacauuguaaagaacacauacaacaauacaugacagaacuacuuauguggcaaaagccagcccucucuggcgaggcaauucuaaagaugcuaggcaaaugcacacacgagaaaaaugaauuuaaagcagcaaaacauacuuacuccgccgaaagauuuguauggcuuacuaaacuuaacaacuuaagaauccuagaagacggcgcagaaagagcacuaaaugaagaagaacgacaacuauuaauaaaucacccuuacgaaaaaucgaaacuaacauacgcgcaaguaagaaaacuucucgguuuaucagaacaagcaauauucaaacauuuaagauauucuaaagaaaaugcagaaagcgcaaccuucauggaauuaaaagcauggcacgcuauaagaaaagcucuugaaaaccaaggguuaaaagauacauggcaagaucuagcaaagaaacccgacuuacuagacgaaaucggaacggcuuuuagccuauauaaaacagaugaagauauacaacaauaccucacgaauaaaguaccaaacaguguuauaaacgcacuauuagucucauuaaacuuugauaaguuuauagaguuaucacuaaaaucgcuccgaaaaauauuaccucuaauggaacaagguaaacguuacgaccaggcuugccgugaaauauauggacaucacuacggggaagcaaaucagaaaacuucacaacuauuacccgcaauaccugcccaagaaauaagaaauccgguaguacuaagaacacuaucacaagcacgaaaaguaauaaaugccauaauaagacaauacggaucuccagcaagaguacauauagaaacagggagagaauuagguaaaucuuucaaagaacgaagggaaauccaaaaacaacaagaagauaauagaacaaaaagagaaucagcuguacaaaaguuuaaagaacuauucuccgauuucucuucggaaccaaaaaguaaagauauauuaaaauuuagacucuaugaacaacaacacggcaaaugcuuauauucaggcaaagaaauaaauauacaucgacucaaugaaaaaggauacguugagaucgaccacgcacuuccguuuaguaggaccugggaugacucauuuaacaauaaaguccuaguauuagcaucagagaaccaaaauaaaggaaaucaaacuccuuacgaaugguuacaaggcaaaaucaacucagaacgauggaaaaacuucguagcauuaguauuaggaagucagugcucggcggccaagaaacaaagacuacuuacgcaaguaauugaugacaacaaauucaucgauagaaaccuaaacgacaccagauacauagcgagauuuuuauccaauuacauacaagaaaauuuauuauuaguagguaaaaacaagaaaaauguauucacacccaacggacagauaacagcgcuauuacgaucucgauggggauuaauaaaagcccgagaaaauaacaacagacaccacgcauuagaugcaauaguaguagcuugcgcaacaccuagcaugcaacagaaaauuacccgauuuaucagauucaaagaagugcacccuuauaaaauugaaaaccgauacgagaugguagaccaagagagcggagagaucauauccccacacuuuccagaaccaugggcauauuucagacaagaagucaacauacgagucuuugauaaccauccagacacugugcugaaagaaauguuacccgaucgcccacaagcaaaucaucaauuuguacaaccccuuuucguuucaagagccccaacuagaaagaugaguggacaaggacacauggagacuauaaaaucggccaaacgacuagccgaaggaauauccguacuaagaauacccuuaacacaacuaaaaccaaaucuacuggaaaauaugguaaacaaagaaagagaaccagcucuauacgcaggccuaaaagcaagacuagcagaguucaaccaagauccagcaaaagcauucgcaaccccauucuacaaacaaggaggacaacaaguuaaagcaauccgagucgaacaaguccaaaaaucuggaguacugguucgcgaaaacaacggaguagcagacaaugcgucaauuguaagaaccgacguauucauuaaaaacaauaaauucuuucucguacccauauacacauggcaaguggcuaaggggauucuacccaacaaagcuauaguagcccauaaaaaugaagacgaaugggaggaaauggacgaaggagcaaaauuuaaauucucucuuuuuccuaacgaccuugucgaauuaaaaacaaagaaagaauacuuuuucggauauuacaucggauuagacagagcaaccggaaacauaagucuaaaagaacacgacggagaaauaagcaaaggaaaagacggaguauauagaguaggaguuaagcucgcauuaucauuugaaaaauaucaagucgacgaacugggcaaaaaucgacaaauaugccguccccaacaaagacaaccagucagauga

SEQ ID NO: 4870 - RNA, 3249 nt, Artificial Sequence
  Cas9 variant
auggccgccuucaaaccaaauccuauaaacuauaucuuaggcuuagacauaggaauagcauccguuggaugggcaaugguggaaauagaugaagaugaaaauccuauaugccuaauagauuuaggaguuaggguauuugaaagagccgaaguaccaaaaacaggagauagccuugccauggcgagaagauuagcaagaucuguaagaaggcuaacacgacggagagcacauagacuacuacgagcaagaagacuauuaaagagagagggaguuuuacaagcagcagacuuugaugagaauggauuaauaaagucccuuccuaauacaccauggcaacuucgagcagcugccuuagacaggaagcuaacaccauuggaguggucagcuguauuauuacaucuaauuaaacauagggguuauuuaucucaaaggaaaaacgaaggagaaacagcugacaaagaacuaggggcacuacuaaaaggcguggcagacaaugcccacgcauuacaaacaggagauuuuagaaccccugcagaauuagcacuaaauaaguuugaaaaggaaucaggacacaucagaaaucaaagaggggauuauucacauacauuuuccagaaaagaucuucaagcagaacucauuuuauuauuugaaaaacaaaaagaauuugggaauccacauguaagcggaggacuaaaagaaggaauagaaacauuacuuaugacacaaagaccagcacuaaguggggaugcaguccagaaaauguuaggacauugcacauuugaaccugccgaaccaaaagcugcgaaaaacacauacacagcagaaagauuuauuugguuaacaaaacucaacaaucuaagaauacucgaacaagguucugaaaggccauuaacugacacagaaagagcgacacuaauggacgaaccauacaggaaaucaaaauugacuuaugcacaagccagaaaauuguuaggacuagaagauaccgcuuucuuuaaaggacugagauaugguaaagauaaugccgaagcgucaacccugauggaaaugaaagcauaucacgcuauaaguagagcucuggaaaaagaaggauuaaaagacaagaaaucuccauuaaaccuaucgccagaauuacaagaugaaauagguacugcauuuucccuuuuuaaaacagacgaagauauuacgggaagauuaaaggaccgcauccaaccagaaauuuuagaggcuuuacuaaaacacauaucauuugauaaguucguucaaauaagucugaaagcauuaagaagaauaguuccuuuaauggaacaagggaaaagauaugaugaagcaugugcagaaauauauggugaccauuacgggaagaaaaacacggaagagaaaauauauuugccaccaauaccagcugaugaaauuaggaacccagucguauuacgagcauuaucacaagcaagaaaaguuaucaacgguguagugcgacgauaugguagcccggcucgaauacacauagaaacagcaagagaaguaggaaaaaguuuuaaagacagaaaagaaauagagaaaagacaagaagaaaaucgcaaagauagagaaaaagccgccgcaaaauuuagagaauacuuccccaauuuuguaggugaaccaaaaucaaaagacauacuuaaacuaagacuauacgaacaacagcacggaaaauguuuauauuccggcaaagaaaucaaucuugguagacucaaugaaaaagguuauguagaaauagaucaugcacuaccguuuagcagaacaugggaugauagcuucaauaauaaaguacuuguauuaggaagugaaaaucaaaauaaagggaaucaaacaccauaugaauacuucaacggaaaagauaacagcagagaauggcaagaguucaaagcucgaguagaaacaagcagauucccucguaguaagaaacaacgcauauugcuccaaaaauucgacgaagauggcuucaaagaaagaaaucuaaaugauacgagauacgucaauagauuuuugugucaauuugucgcugacaggaugagacuaacagguaaaggcaaaaagagaguauucgcuagcaauggacaaauaacuaacuuauugcgcggauuuuggggauuaagaaaaguaagagcagaaaacgacagacaccaugcauuggacgcagucguaguagcaugcagcacaguagcaaugcaacaaaagauaacuagauucguacgauauaaggaaaugaacgcauucgaugggaaaacaauugauaaggaaacaggugaaguacuacaucagaagacucauuuuccacaaccuugggaauuuuucgcccaagaaguuaugauucgaguauuuggaaaaccagauggaaaaccagaauuugaagaagccgauacuccagaaaaacuacgcacauuacucgcggaaaaacuaucaagcagaccagaagcaguucaugaauauguuacuccacuuuucguaucaagagcaccuaauagaaagaugucgggucaaggacacauggaaacaguaaaaagugccaaaagacuagaugaaggcguaaguguguuaagaguucccuugacgcaacuaaaacuaaaagauuuagagaaaauggucaauagagaaagagaacccaaauuauacgaagcacucaaagcaagauuagaagcacauaaggaugauccagcaaaagcauuugcugaaccuuucuauaaauaugauaaagcggguaacagaacccaacaaguuaaagcaguaagaguugaacaaguacagaaaacaggcguuuggguaagaaaccacaacggaauagcagauaacgcuacaaugguaagaguagauguguuugaaaagggagauaaguacuauuugguaccaaucuauagcuggcaaguugcuaaagggauacuaccugaccgugcaguaguacaaggaaaagaugaagaagacuggcaacuaaucgacgacucauuuaauuucaaauuuaguuuacacccuaacgacuuagucgaaguuauaacuaagaaagcuaggauguuuggauauuuugcaagcugccauaggggcacuggaaauauaaauauaagaauacacgauuuagaucauaaaauugguaaaaacggaauauuagaaggaauaggcgucaaaacugcauuaucuuuucaaaaauaucaaauagaugaauuaggaaaagaaauuagaccauguagacucaagaaacgaccuccaguccgauga

SEQ ID NO: 4871 - RNA, 3255 nt, Artificial Sequence
  Cas9 variant
augaaauaucauguagguauagacgucggaacauuuucaguuggacuggcugcaaucgaaguagaugacgcaggcaugcccauaaagacucuaaguuuaguaucucacauacaugauagcggauuagacccagaugaaauaaaaagugcagugacaagacuugccaguagugguauagcaagaagaacaagaagauuauacagaagaaagagaagaagauuacaacaguuagauaaguuuauacaaaggcaaggguggccaguuaucgaacuagaagauuacagugauccacuauauccauggaaagugcgagcugaauuagccgcuagcuauaucgcugacgaaaaagaaagaggagaaaaacuaucagucgcccuucgccauauugcacgacacagaggcuggcgaaaccccuaugccaaaguaaguucacuauauuuaccugaugguccaucugaugcuuuuaaagcaauaagagaagaaauuaaaagggcaagcggucaaccuguaccggaaacagcuacaguaggacaaaugguuacgcuaugugaguuaggaacuuugaaacuaaggggagaaggagggguacuaagugcaagauuacaacaaagugauuaugcaagggaaauucaagaaauuuguagaaugcaagagauaggucaagaauuauacagaaaaauuaucgauguuguuuuugcagcggaaaguccgaaaggaagugcuagcagccguguagggaaggauccauuacaaccagguaaaaaucgcgcauuaaaagcaagcgaugcguuucaacgguacagaauagcagcauugaucggaaacuuaagaguaagaguggauggggaaaagagaauccuuucgguagaggagaaaaaucuaguauuugaucaucuaguuaacuuaacaccuaagaaagaaccagaauggguaaccauagcggaaauacuagguauagaucggggacaauuaauaggaaccgccacuaugacugaugauggugaaagagccggagccagaccuccaacucacgacacuaauagaucaaucguaaauaguagaauagcaccuuuaguagauugguggaaaacggcgucugcacuagaacaacaugcuaugguaaaagccuuaaguaaugccgaaguugaugacuuugauucuccggaaggagccaaaguacaagcauucuuugcugaucuugaugacgacguacaugcuaaacuagauucacugcauuugcccguagguagggcggcguacagugaagauacucuaguacgauuaacaagacguauguuaagugaugggguagaucuauacacugcaaggcuacaggaguucgggauagaaccgaguuggacgccacccacaccaagaauaggugaacccguaggcaauccagcuguagauaggguucuaaaaacaguaaguagguggcuugaaucagcaacuaaaacauggggugcuccagaaagagugauuauagaacaugugagagaaggguucgucacagagaaaagagcuagggaaauggacggagauaugaggcguagagcggccagaaacgcaaaauuauuccaagaaaugcaagaaaaauugaacguacaaggaaaaccuucaagagcugaucuauggagauaucaaaguguacagagacaaaauugccaaugcgcauacuguggaagcccaaucacauuuagcaauucggaaauggaccauauaguaccucgagcgggucaaggaucaacaaauacucgagaaaaucuaguagcaguaugucauagaugcaaucagucaaaagggaauacaccauuugcaaucugggcgaaaaacaccaguauagaagguguaagcguaaaagaagcaguagaacgaaccaggcauuggguaacagauacaggaaugcgaagcacggacuuuaaaaaguuuacaaaagcaguuguagaaagauuccaaagagcaacaauggacgaagaaauagaugcucgaucaauggaaucaguagcuuggauggcaaacgaacuaagaucuagaguagcacaacauuuugcaucacauggaaccacgguaagaguauauagagguaguuuaaccgcagaagcuagacgagcaucaggaauuaguggaaaacuaaaauucuuugauggaguugguaagucgagauuagauagaagacaucaugcgauagaugcggcuguaauagcauuuacaagugacuauguggcagaaacuuuagcuguaagaaguaacuuaaaacaaucgcaggcacauagacaggaagcuccacaauggagagaguuuacaggaaaagaugccgaacaucgggcggcauggagaguuuggugucagaaaauggaaaaacuuagcgcacuacuaacagaagaccuuagagacgaucgggugguuguuaugaguaauguuagacuacgauuaggaaauggaagcgcccacaaggaaacgauagggaaacuaucaaaaguuaaauuaucaucacaacugagugugucagauauagacaaagcaucauccgaagcauuguggugugcauuaacucgagaaccaggauuugauccaaaagagggucuaccggcaaaucccgaacggcauauaaggguaaacggcacacacgucuaugccggugauaauaucggguuauucccgguaagcgcaggaaguaucgcacuaagagggggauaugcagagcuaggcucauccuuccaucaugcacgaguguacaaaauuacgagcggcaagaaaccagcauuugcuaugcuuaggguauauacaauugaucuauuaccauauagaaaccaagauuuauuuaguguugaacuaaaaccacaaacaaugucaaugagacaagcagaaaagaaauuaagagaugcuuuagccacuggaaaugccgaauaucucggauggcugguuguugaugaugaacuugucguagauacuucaaaaauagccaccgaucaagugaaagcaguagaagcugaacuagggacuauuagaagauggagaguagacggcuucuuuagcccaucaaaauuaaggcuaagaccacuacaaaugucuaaagaaggcauuaagaaagaaagcgccccagaauuaucaaaaauuauagauagaccggguugguuacccgcugugaauaaacuauuuuccgaugguaauguaacagucgugagacgugacucucuuggucgaguaagacuagaaaguacugcgcaccuaccaguuacauggaaagugcaauga

SEQ ID NO: 4872 - RNA, 2955 nt, Artificial Sequence
  Cas9 variant
auggcaagaauucucgcauuugauaucggaaucucaucaauaggaugggcauucagcgaaaacgacgaacuaaaagauuguggggugcgcauauuuacaaaagucgaaaauccaaaaacuggagaaucguuagcacuaccacgaagauuagcucgaucugcccgaaaaagacuugcccgaaggaaagcaagacuuaaucaccuaaaacaucuaauagcaaacgaauucaaacuaaauuacgaagacuaucaaagcuuugacgaaucauuagccaaagcauauaaaggaagccucauaucuccauaugaauuaagauuuagggcucugaacgaacuauuaucaaaacaagacuuugcaagaguaauauuacacauagcaaaacgaagaggauacgaugacaucaaaaauuccgacgauaaagaaaaaggagcuauacuaaaagcaauuaaacaaaacgaagaaaaacuugcuaacuaccaaucagugggagaauaccuauauaaagaauacuuccaaaaauucaaagaaaauagcaaagaauucacaaaugucaggaacaaaaaagaaaguuaugaacgaugcauagcucaaucauucuuaaaagaugaauuaaaacuaauauuuaaaaaacaaagagaauucggauuuuccuucagcaaaaaauuugaagaagaaguacuuagcgucgcauuuuauaaaagggcacucaaagacuucagccaccuaguagggaacugcucauucuuuaccgaugaaaaaagagcaccaaaaaauucgcccuuagccuucauguucguagcacucacaaggauaaucaaucuacuaaauaauuuaaaaaacacagaaggaauacuuuauacaaaagacgaucuaaacgcauuacuuaacgaaguacucaaaaauggaacucuuacauacaagcaaacaaaaaaacuacuaggacuauccgacgauuacgaauuuaaaggagaaaaaggcacauauuucauugaauucaaaaaauacaaagaguuuauaaaagcucucggagagcauaaucuaucccaagacgacuuaaacgaaaucgccaaagacauaaccuuaauaaaagacgagauaaaguuaaaaaaagcacucgcaaaauacgaucugaaccagaaccagauagauagccucucaaaacuggaguucaaggaccaccucaauauaagcuucaaagcauuaaaacuaguaacuccccugaugcuggaaggaaaaaaauaugaugaagccugcaacgaauugaaccuaaaaguagccaucaaugaagacaaaaaagauuucuuaccagcauuuaaugaaacauacuauaaagaugagguuacaaaucccguaguacuuagagcaauuaaggaguaccgaaagguuuuaaaugcucuacuuaaaaaauacgggaaaguacacaaaaucaacauagaguuagcacgagaaguagggaaaaaucacucucaaagggccaaaauagaaaaagaacaaaacgaaaauuauaaagcaaaaaaagaugcagaacuagaaugcgaaaaacuaggauuaaaaauaaacuccaaaaauauauugaaauuacgucuauucaaagaacaaaaagaguuuugcgcauauucaggagaaaaaaucaaaaucucagauuuacaggaugaaaagaugcuagaaauugaccacauauacccauacuccagaucauucgaugauagcuacaugaacaaaguacuaguuuucaccaagcaaaaccaagaaaagcuaaaucaaacaccauucgaagccuuuggaaaugacagcgcaaaauggcaaaagauagaaguauuagccaaaaaccucccaacaaaaaagcaaaaaaggauacucgacaaaaacuauaaagacaaagaacaaaaaaacuuuaaagauagaaacuuaaaugacaccagguacauugcucgacucguauuaaacuacaccaaagacuaccuagacuuccuuccccucucagacgacgaaaacacuaagcuuaacgacacccaaaaaggaagcaagguacaugucgaagcuaaaucaggaaugcuuaccuccgcacuucgacauacauggggcuuuucagcaaaagacaggaacaaucaccuacaccacgccaucgaugcagucaucauagcauacgcaaacaauagcauuguaaaagcauuuagcgauuucaaaaaagaacaggaaagcaauucagccgaacuguaugcaaaaaaaauuagcgaacuagauuacaaaaauaaaagaaaguucuuugaaccuuucucaggauucagacaaaaaguacucgacaaaauagacgaaauauucguaaguaaaccagagagaaagaaaccuaguggagcauuacacgaagaaacauucagaaaagaagaagaauucuaccaaucauaugguggcaaagagggaguacuaaaagcacuagaacuagguaaaauacgcaaaguaaacggaaaaauaguaaaaaauggcgacauguuuagagucgauauauucaagcacaaaaaaacaaacaaauuuuaugcaguucccauauauaccauggauuuugccuuaaaaguccuaccaaauaaagccguugcaagaucaaaaaaaggagaaauuaaagacuggaucuuaauggaugaaaacuacgaauuuuguuuuuccuuauacaaagacagccuuauccuuauacaaaccaaagauaugcaggaaccugaauuugucuauuauaaugcuuucaccagcucaaccguuucacuaauagugucaaaacaugauaacaaguucgaaacacugaguaagaaccaaaaaauauuguuuaaaaacgcaaaugaaaaagaagugauagcaaaaucuaucggaauucaaaaccuaaaaguauucgaaaaauacauaguuagcgcauuaggagaaguaacaaaagcugaauuccgacaaagagaagacuucaaaaaauga

SEQ ID NO: 4873 - RNA, 3366 nt, Artificial Sequence
  Cas9 variant
auguccgaccuaguauuaggacuagacauaggaauaggcucaguaggaguuggaauuuuaaacaaagucacaggcgaaauaauucacaaaaauucacgaauuuuuccggcagcccaagccgaaaauaaucuaguaagacgcacuaauagacaaggacgaagacucgcaagacgaaagaaacauagacgaguaagauuaaauagacuauucgaagaaaguggacucauaacagacuucacaaaaauuucuauaaaucuaaacccuuaucaauuacgcguuaaagggcuaacugaugaacuauccaacgaagaauuauuuauagcacuuaaaaauaugguaaaacauaggggcauaaguuauuuagacgaugcauccgacgacggaaacagcuccguaggugacuaugcacaaauaguaaaagaaaacucuaaacaguuagaaacaaaaaccccuggacagauucaauuagaaagguaccaaacuuauggccaauuaagaggcgacuucacagucgaaaaagacggaaagaaacauagacuaaucaauguauuuccaacaucugcauaucgaagugaagcguugaggauacuucaaacucaacaagaguucaacccucaaauaacagaugaauuuauaaauagauaucuagaaauacuaacaggaaaaagaaaauauuaccauggaccaggaaaugagaaaagcagaacugacuauggacgguaccgaacaagcggugaaacauuagauaauauuuucggaauccuaaucggaaaaugcacauucuaccccgaugaauuuagagcggcuaaagcaucauacacagcacaagaguucaauuuacuaaacgaccuaaacaacuuaacaguccccaccgaaacaaagaaacuaagcaaagaacagaaaaaccaaauuaucaauuacguuaaaaaugaaaaagcaaugggacccgcuaaacuauuuaaauauaucgcaaaacuccuuucaugcgauguagcggacauaaaaggguacagaaucgacaaaucaggaaaagcagaaauacauacuuucgaagcauauagaaaaaugaaaacauuagaaacacuagacaucgaacaaauggacagagaaacacuagauaaauuggcguauguacuaacacucaacacugaaagggagggaauacaagaagcucuugaacaugaguucgcagaugggagcuuuucacaaaaacaagucgacgaacuuguacaauuccguaaagcaaacaguucaauauucggaaaaggauggcauaacuuuagcgugaaauuaaugauggagcuaauaccagaauuauacgaaacaagugaagaacaaaugacuauauugacacgucuaggaaaacaaaagacaacgaguuccaguaacaaaacuaaauauauagaugaaaaacuacuaacagaagaaauuuauaaccccguuguagcuaaauccgucagacaagcuauuaaaaucguaaaugcugcaauaaaagaauacggagauuucgauaacauaguaauagaaauggcacgagaaacaaacgaagacgaugaaaagaaagcaauacagaaaauucaaaaagcaaacaaagaugaaaaagacgcagcaaugcuaaaagccgcaaaccaauacaacggaaaagcugaacugccacauucgguuuuccacggacauaaacaauuagcaacaaaaauaagauuauggcaucaacaaggcgaaagaugcuuauacacaggaaaaacaaucucaauucacgaccugauuaacaacagcaaucaguucgagguagaucauauccuaccccuaucuauaaccuuugaugacucucucgccaacaaaguucuaguauaugccacugcaaaucaagaaaaagggcaaagaacucccuaucaagcauuagauucgauggaugaugcauggucauuuagagaacuaaaagccuucguuagggaaaguaaaacauuaucgaauaaaaagaaagaauaucuuuuaacagaagaggacaucucaaaauuugacguuagaaagaaauuuauagaacgcaaucuagucgacacccgauaugcguccagaguuguauuaaaugcacuccaggaacauuuuagagcucauaaaauagauaccaaaguaucaguaguaagaggacaguucacaagccaauuaagaagacacugggguauagagaaaacaagagacaccuaccaccaccaugcugucgacgcccuuauaaucgcagcuucaagccaacuaaacuuauggaagaaacagaaaaauacccugguaagcuauagugaagaucaacuacucgauauugaaacaggagaauuaauauccgaugaugaauacaaagaauccguauuuaaagcaccauaccaacacuuuguggacacauuaaaaucaaaagaguucgaagacuccauacuuuucucauaccaaguagauucaaaauucaaccguaaaauaagcgaugcaacaauuuaugcuacgcggcaagcaaaaguaggcaaagacaaagcagacgaaaccuaugugcugggaaaaauaaaagacauauauacacaagacggauacgacgccuucaugaaaauauauaagaaagauaaaucaaaauuuuuaauguauagacacgacccacaaaccuucgaaaaaguaauagaacccauucuggaaaauuauccaaacaaacaaauaaacgaaaaaggcaaggaaguucccuguaacccauucuuaaaauauaaagaagaacacggauacauuagaaaauauucaaagaaaggcaaugggccagaaauaaaaaguuuaaaauauuaugacaguaaacuggggaaccacaucgauauaaccccgaaagacucaaauaauaaaguaguccuucaauccguaucacccuggagagcagaugucuauuuuaacaaaacgaccggaaaauaugaaauacuaggcuuaaaauaugcagacuuacaauucgaaaaagguacaggaacuuauaaaauaucacaagaaaaauauaacgacauuaagaagaaagaaggaguugacagcgacucagaguucaaauuuaccuuguauaaaaacgaccuccuucuugucaaagacaccgaaacaaaagaacaacaacuuuuuagauuccuuucaagaacaaugccaaaacaaaaacacuauguagaauuaaaacccuaugauaaacaaaaauucgaaggaggggaagcguuaauaaaaguccucgguaacguagccaacuccggacaguguaagaaaggccuaggcaaaucaaacauauccauuuacaaaguaaggacagacguuuugggaaaucagcacaucauuaaaaacgaaggagacaaaccaaaauuagauuucuga

SEQ ID NO: 4874 - RNA, 2556 nt, Artificial Sequence
  Cas9 variant
augacaaaugguaaaauacuuggacucgauauuggcguugcuaguguaggaguaggaaucauagaagcgaaaacaggaaaaguaauucaugcaaauagccgguuauucuccgcggcuaaugcagaaaacaacgccgaaagaagaggauuccgcggagcaagacgacuaacacgaagaaagaaacacagaguaaaaagaguaagagaucucuucgaaaaauacgauaucuuaacugacuucagaaauuuaaaccuuaacccauacgaacuacgggucaaaggacuaaccgaacaacucacaaacgaggaauuauucgcagcacuucgaacuauagcaaaaagacgcggcauaaguuacuuagacgaugcagaagaugauucaacugggucauccgauuacgccaaauccauagacgaaaacagaagacuauuaaaaucuaugacccccggacaaauacaacuagaaagacuagaaaaauauggacaacucagaggaaauuucacaguuuaugacgaaaauggugaagcccacagacuaauaaacguauucaguaccuccgauuauaaaaacgaagcuagaaaaauauuagaaacacaaucaaauuauaauaaacaaauaacagacgaguucauagaagauuacauagaaauacuaacacagaaaagaaaauacuaucacggaccaggaaacgaaaaauccagaacagauuauggaagauuuagaaccgacggcacaacucuugaaaacauauucggcauacuaauagguaaaugcucauucuauccagaagaauacagagcauccaaagcgagcuacacggcacaagaguucaauuuccugaacgaucugaacaaucuaaaaguaccgacagaaacaggaaaauuguccacagaacaaaaagaauaucuagucaacuucgccaaaaauucaaaaacacucggagcaaguaaacuacuaaaagaaauagcaaaacucgucgauggagauguaaaagacauaaguggauauagggaagacucuaaagguaaaccagaucuacauaccuucgaaccauauaggaaacuuaaauuuaaccuaacaacaguagacauagacaauuuaaguagagauauauuagauaaacuugcagauauccucacacuaaacacagaacgagaaggaauagaagacgcaaucaaucaaaaucuaccagaacaauucaccaaagaacaaaucucagaaauagugcaaauacgaaaaagucaaagcucagcauucaacaaaggauggcacucuuucucagccaaacuaaugaacgaacuaauaccagaauuauacgcaacaagcgaggaacaaaugacaauuuuaacaaggcucgaaaaauucaaagcaacaaagaaaucaaguaaaaauaccaaaacaauagaugaaaaagaaauaacugacgaaaucuauaauccaguaguggcaaaaucaguaagacaaacaaucaaaauaauaaacgcagcaguaaagaaauauggugauuuugacaaaauaguaauagaaaugccaagagacaaaaaugcagaugacgagaagaaauucauagauaagaaaaauaaagaaaauaagaaagaaaaagaugacucacugaaaagagcggccuaucuauacaacggaacugacaaacuaccugacgacguauuccacggaaacaaacagcuagccacaaaaaucagguugugguaucaacaaggagaaagaugccuauacagcggaaaaccaauacuaauacaagaucuaguucacaacucaaacaacuucgaaaucgaucauauacuacccuuaucauuaaguuucgacgacagcuuagcaaacaaaguauuaguauaugcaugggccaaccaagagaaagaacagaaaacgcccuaccaaguuauagauucaauggacgcagcaugguccuuuagagaaaugaaagacuacguacuaaaacaaaaagguauaggaaagaagaaaagagaauaucuacuaacuacagaaaacauagauaaaauagaaguaaagaagaaauuuauugaaagaaaucuaguagacacuagauaugcaaguagaguaguacuaaacaguuuacaaacagcauuaaaagaauuaggaaaagacacaaaaguuagcguagucagaggccaauucacaucccaacuacgaaggaaauggaaaauagauaaaagccgagaaacauaccaccaccacgccguagacgcccuaauaauagcagcaaguucccaacuaaaauuauggcaaaaacacgaaaauuuaauguuugaaaauuacggagaaaaucaaguaguaaauaaagaaacaggugaaauacucaguauaagcgacgacgaauauaaagaaucgguauuucaaccacccuaucaaggguucgugaauacaaucucgucaaaagcguuugaagacgaaauuuuauucaguuaccaaguugacucaaaauuuaaucgaaaagucucagacgccacgauauauucgacaagaaaagcaaaacuaggaaaagauaagaaagaagaaaccuacguacuuggaaaauga

SEQ ID NO: 4875 - RNA, 2598 nt, Artificial Sequence
  Cas9 variant
augagacacaaaaucggacuagacaucggaauaaccaguguuggcugggcaguaauaaaucuagauauaccucguaucgaagaucuaggaguacgaauuuucgacagggccgaaaauccucagaccggagaaucauuagcacuacccagaagacuugcaaggucugccagaagaagacuaagacgaagaaaacacagacuggagagaauacgaagacucuuaauaagagaagguauauuaacaaaagaagaacuagauaaauuauuugaagaaaaacacgaaauagacguauggcaauuaagaguagaagcauuggauaggaaacuaaacaacgaugaauuagcacguguucuacuacacuuagcaaaacgaagaggauuuaaaucaaauagaaaaucagaaagaaauaacaaggagaacagcacuaugcugaaacacauagaagaaaauagagcauuguuauccgguuacagaacaguagcagaaaugauaguaaaagacccaaaauuugcauuccacaaaagaaauaaaggagaaaacuauaccaauacuauagcgagagaugaccuagaaagagaaaucaaacuaauauuuacgaaacaaagagaauauggaaacauuguguguacagaaacauuugaaaacgaauauauuaugauuugggcaagccaacgaccauuugcaucaaaaaacgauauagaaaaaaaaguagguuuuuguacuuuugaaccaaaagaaaaaagagcuccaaaagcaacauauaccuuccaaaguuuugucgcaugggagcauaucaauaaacuccgauuggucuauccaaccggaacacgaggacuaaccgacgaagaaagacgauuguuauauaaacaagccuuccacaaaaauaaaauaacuuaucaugauauaagaacuuuacuucauuuaccagaugacacauacuuuaaaggaaucguuuaugacagaggagccccacuaaaacaaucagaaacaauaagauuuuuagaacucgacgcuuaucaucaaauaagaaaagcaguagacaaaguauauggcaagggaaaaaguucaucauuccuuccaaucgacuuugacacauucggauaugcacuaacacuauucaaagacgacgcugacauaagaucauauuuaagaaaugaauaugaacagaacgguaaaagaaugccaaaucuagcaaacaaggucuacgauaaugagccuaucgaggaacucuuaaaucuaucauuuacaaaauucggacaccuaucucuuaaagcauuacgcaacauacuuccauacauggaacaaggagaaguuuauucaguagcuugugaaagggcaggguacaccuucacaggaccaaaaaaaaaacaaaaaacacuacuacuaccaaacauaccaccaauagcaaaccccgucguaaugcgcgcacucacacaagcaagaaaaguuguaaaugcaauaaucaaaaaauacgguucgccaguaucgauacacauagaacucgccagagaucuaucccaaacauucgacgaaagaagaaaaacaaaacgagaacaagaugaaaaucguaaaaaaaacgaaacagccauaaggcaguugauggaauacggacuaaccauuaacccuaccggacaugauauuguaaaauuuaaacuaugguccgagcaaaauggacggugugccuauucucuacaaccaauagaaauagaaagacuucuagaaccaggauacguugaaguagaccacguaauaccauauagccgcagucuagacgacucuuauacgaacaaaguacuugugcuaacaaaagaaaauagagaaaaagguaaccgaauaccagcagaauauuuaggagucgggacagaaagauggcaacaauuuaaaacauuuguacuaacaaacaaacaauucucuaaaaaaaaaagagauagauuacuaagauugcacuacgacgagaaugaagaagcugaauggaaaaaccgaaauuuaaaugauacuagauauauuucaagauuuuucgccaauuuuauccgcgaacaccuaaaauuugcagaaucagaugauaaacagaaagucuacacaguaaauggaagagugacagcccacuugaggagccgaugggauuuuaauaaaaaccgagaagaaagugacuuacaccacgcaguugacgcugcaauagucgcaugcacuucacccuccgacauagcaagaguaacagcauuuuaucaacgcagggagcaaugcaaagagagugccaaaaaagcggaaccccacuucccccaacccuggccucauuuugcugaugaauuacgagccagacuaucgaaaaaucccaaagagucaauaaaagcuuuaaacuuaggaaacuaugaugaccaaaaacuagaaucucuacaaccaguguuuguaucacgaaugccaaaacgcucaguuacuggagcagcacaucaggaaacauuacgcagauauauuggaaucgacgaaagauccgguaaaauacaaaccguagucaaaacaaaacuuucagaaauuaaauuagaugaaacaggacacuucccaauguauggcaaagaaucagaccccccagcaagugcauga

SEQ ID NO: 4876 - RNA, 2886 nt, Artificial Sequence
  Cas9 variant
auggcaagaauacuugcuuuugauauagguauuagcagcauaggcugggccuucucugaaaaugacgaacucaaagacuguggcgucagaaucuucacaaaagcugaaaauccaaaaacaggcgaaucacuagcacuuccccgaagacuagcaagaucagcacgaaaaagacuugcucgccgaaaagcaagauuaaaccaucuaaaacaucuaauagcaaacgaauucaaacuaaacuacgaagacuaccaaucauuugacgaaucuuuagcaaaagcauauaaaggcucacuaaucaguccuuacgaacucagauucagagcacucaacgaacuacuaaguaaacaggacuucgcaagaguaauacugcacauagcaaaaagaagaggauacgaugacauaaaaaacaauggagacgaagaaaaaggaaaaauauuaaaggcaauaaaacaaaacgaagaaaaauuagugaacuaucaaagcguaggagaauacuuauacaaagaauacuuucaaaaauucaaagaaaauucuaaagaauucauuaauguaagaaacaaaaaagaaaguuacgaaagaugcauaacacaaaguuuccuuaaauaugaacuaaaacuaaucuuccaaaaacaaagagaauucggauucuccuuuuccaaaaaauucgaagaagaaguacuauccguagcauuuuauaaacgagcacuaaaagauuucagucaccuugucggaaauugcuccuucuucagcgacgaaaaaagagcaccaaaaaacuccccacucgcauuuauguucgucgcacuaacacgaaucauaaacuuacuaaauaaccuaaaaaauacagaagguauccuuuacacaaaggaugacuuaaacgcacuucugaacgagguacugaaaaauggaacucuaacauacaaacaaacaaaaaaauuauuaggauuaagugacgacuaugaauucaaaggcgaaaaaggcacauauuuuauagaauucaaaaaauacaaggaauucauuaaagcauuaggggaacauaaccucucacaagacgaccuaaacgaaauagcuaaagauauaacuuugauaaaggaugaaauaaaacuaaaaaaagccuuagcaaaauacgaccuaaaccaaaaucaaauagacucauuaucaaaacuagaauucaaagaccaccucaacauaggguucaaagcacuaaaacuaaucacccccuuaauguuagaagguaaaaaauaugaugaagcauguaaugaacuaaauuuaaaaguugccaucaaugaggacaaaaaggacuuucuacccgccuuuaaugaaacuuauuacaaagaugaagucacaaaccccguagucuuacgagcaauaaaagaauacaggaagguacuuaacgcauuauuaaaaaaauacggaaaaguacacaaaauuaacauagaacuagccagagaaguugguaaaaaccacagccaaagagcaaagauugaaaaagaacaaaacgaaaacuacaaagcaaaaaaagaugcagagcuagaaugcgaaaaacucggacuaaaaauaaacuccaaaaacauauuaaaacuccgguuauuuaaagaacagaaagaauucugugcauacucaggugaaaagauaaaacugagugaccuacaggacgagaaaaugcuagagaucgaccacauauacccauauuccagaagcuuugaugauagcuauaugaacaaagugcucguuuucacaaaacaaaaccaggaaaagcuaaauaaaacuccauucgaagcauucggaaacgacaacguaaaauggcaaaaaauagaaguuuuagcuaaaaaccuaccagaaaaaaaacaaaaaagaauauuagacaaaaacuacaaagacaaagaacaaaaagacuuuaaggauaggaaccuuaacgauaccagauacauagcucgauuaguauuaaacuacacaaaagacuaccuagacuucuuaccucucucagacgacgaaaacaccaaacucaaaggaucaaaaguucauguagaagcaaaaucaggaauguuaacaagcgcacuaaggcauacaugggguuucaguacuaaagacaggaauaaccaccuacaccacgcaauagacgcagcaauuauagccuacgcaaauaacagcauaguaaaagacuucagcgacuuuaaaaaagaacaagaaucuaacucagccgaacucuaugcuaaaaaaauauccgaauuagacuacaaaaauaaacgcaaauuuuucgaaccuuuuucaggauucagacaaaaaguguuagauaaaauagaugaaauauuuguaucaaaaccagaacgcaaaaaaccuagcggcgcucuacaugaagaaacauuuagaaaagaagaagaauuuuaucaaagcuauggaggcaaagaaggaguacuaaaagcacucgaacuaggaaaaauucgaaagguuaauggaaagauuguaaaaaacggagacauguuccguguagacauauuuaaacacaagaaaaccaacaaauucuaugccgucccuauauacacaauggauuuugcucuuaaaguacuaccaaacaaagccguagcuagaucaaaaaaaggggaaaucaaagacuggauccuaauggacgaaaauuaugaguuuuguuucagccuuuacaaagacagucuaauccuuauacagaccaaagacaugcaagaaccagaacuaguauacuucaaugccuuuaccaguagcacgguauccuuaauaguaaguaaacaugauaauaaguucgaaacacucaguaaaaaccuaaaaguauucgaaaaguauauaguuagcgcacucggagaagugacuaaagcagaguuccgacaaagagaagauuucaaaaacgaacuacgcuga

SEQ ID NO: 4877 - RNA, 2955 nt, Artificial Sequence
  Cas9 variant
auggcaaaaauacuagcauucgauauaggcauaucgagcauaggcugggccuucucagaaaacgaugaacugaaagacugugguguuagaauauuuaccaaagcggaaaacccaaaaacaggagaauccuuagcucuaccaagaagaauagcaaggucugcaagaaagcgauuagcuagacguaaagcaagauuaaaccacuuaaaacaccuaauagcaaacgaauuuaaacuaaauuaugaagacuaccaauccuucgacgaaauccucgcaaaagcuuacaaaggauccuuaauaaguccuuaugaauuaagguuuagagcacucaacgaauuacugucuaaacaagacuuugcacgaguaauucuacacauagccaaacguagaggcuaugacgauauaaaaaacaacggagacgaagagaagggaaaaauacuaaaagcuauaaaacaaaacgaagaaaaacuggccaacuaccaaucuguaggugaauacuuauacaaagaauacuuucaaaaauuuaaagaaaacucaaaagaauuuaucaacguaagaaacaaaaaagaaucauacgaaagaugcauagcacaauccuuccuaaaagacgaacuuaaguuaauauucaaaaaacaaagagaguucggauucucauucagcaaaaaguucgaagaagaaguccuauccguagcauucuacaaaagagcacuaaaggacuucucacauuuaguugguaauugcaguuucuucacggaugaaaaaagggcaccaaaaaacagcccacuagcauucauguucguagcacuuacaagaauaauuaaucuuuuaaacaaccuaaaaaauacacuuuauacgaaagacgacuugaaugcauuauuaaacgaaguccuaaaaaacggaaccuuaaccuauaaacaaacaaaaaaacuacucgguuuaucagacgauuacgaauucaaaggagaaaaagguaauuacuucauagaauuuaagaaauacaaagaauucauaaaagcacucggagaacauucacuaucacaagacgaucuaaacgaaauugcaaaagacauuacacuaauuaaggaugagauuaaauuaaaaaaggcccuugcaaaauaugauuuaaacgaaaaucaaauugauaaccuaagcaaauuagaauuuaaagaucaccuaaacauaucuuucaaagcgcuaaaguuaauaaccccacuaauguuagaaggcaaaaaguacgaugaagcaugcaaugaacuaaccuuaaaaguugcaaucaaugaagacaaaaaagacuuucuaccagcauucaaugaaaccuacuacaaagaugaaguaacaaaccccgucgucuuacgagcaaucaaagaauaucgaaaaguacuaaacgcacuauuaaaaaaauaugggaaaguacacaaaauuaauauagaauuagcacgcgaaguagggaaaaaccauucacaaagagccaaaauagaaaaagagcaaaacgaaaauuauaaagcaaaaaaagacgcagaacucgaaugcgaaaaacuaggacuaaaaauaaauaguaaaaauauuuuaaaacuaagacuauucaaagaacaaaaagaauuuugcguauauagcggagaaaaaauaaaauuaagugaucuacaagaugaaaaaaugcuagagaucgaccacauuuaccccuacagucgaucauucgacgauuccuauaugaauaagguguuaguauucaccaaacaaaaccaagaaaaacucaaccaaacaccauucgaagcauucggaaaugauucugcuaaauggcagaaaaucgaaguauuagcuaaaaaccuaccgaccaaaaaacaaaaacgaauacuagacaaaaacuacaaagacaaagaacagaaagacuucaaggauagaaaucuuaacgauacccgauacaucgcaagauuaguuuuaaacuauacaaaagacuaccuagacuuuuugccguuauccgacgaugaaaacacaaaacucaaugauacacaaaaggguucaaaaguacacguagaggcaaaauccggaaugcuaaccagugcguuaagacacaccuggggauucucuacaaaagaucggaacaaccaccuccaccacgcaauugacgcuguaauaauagcauacgcaaacaacagcauaguuaaagcuuuuucagauuucaaaaaagaacaagaaucaaacacugccgaauuauaugcaaaaaaaauaagugaacuagauuacaaaaacaaaagaaaauucuucgaacccuucucaggauuuagacaaaaaguacuagauaaaauagacgaaaucuucguaucaaaaccagaaagaaaaaagccaucaggcgcacuacacgaagaaacauucagaaaagaagaagaauucuaucaaaguuacgguggcaaagaaggaguucuaaaagcucuagaacugggaaaaauacgaaaaguuaacggaaaaauaguaaaaaacggugauauguuccgaguugacaucuucaaacacaaaaaaacgaacaaauucuacgcagugccaauauacacuauggacuucgcacuaaagguauuaccgaacaaagcagucgcuaggagcaagaaaggagaaauaaaagacuggauacuaauggaugaaaacuacgaauucugcuucucacuauauaaagacucacuaauacucauacaaacuaaagacaugcaagaaccagaauuuguauauuacaacgcauuuacaucauccacagucagccuaauaguaucaaaacacgacaacaaauucgagacccucagcaaaaaccaaaaaauuuuauuuaaaaacgcaaacgaaaaagaagucauagccaaauccauaggcauacaaaaccugaaaguguuugaaaaauacauagucucagcacuaggagaagucacaaaagcagaauuucgacaaagagaagaauucaaaaacgaacugcgauga

SEQ ID NO: 4878 - RNA, 2955 nt, Artificial Sequence
  Cas9 variant
auggcacgaauacuagccuucgacaucggaauaucaucaauuggaugggcauucucagaaaaugacgaacuaaaagacugcggcgugagaauauucacuaaagcugagaauccaaaaacaggagaaagucuagcauuacccagaagacuagccagaucagcaagaaaaagacuugcaagaagaaaagcaagauugaacagauuaaaacauuuaauagcaaacgaauuuaaauuaaacuacgaagacuaucagucauucgacgaaagccuggcuaaggcauauaaaggaucacuaauuagcccuuacgaacuacguuucagagccuugaacgaguuacucucaaaacaagauuuugcaagaguaauacuacacauagcaaaaagaaggggauaugacgauauaaaaaauucagacgacaaagaaaaaggcgccauccuuaaagccaucaaacaaaaugaagaaaagcuagcaaacuaccaaucagucggagaauaccucuauaaagaauacuuccaaaaauucaaagagaacucaaaagaguucaccaauguacgaaacaaaaaagaaagcuacgaaagauguauagcccagucauuccucaaagacgaauuaaaguuaauauucaaaaaacaaagagaauucggauuuagcuucucuaaaaaauuugaagaagaaguccuaagcguggccuucuauaaacgagcacuaaaagauuucucacaccuaguagguaacugcuccuucuuuacugacgaaaagagagcgccaaaaaacucgccguuagcauucauguucguagcauuaacaagaaucaucaaccuacugaacaacuuaaaaaauacagaagguauccuauacaccaaagaugaccuaaacgcccuacucaacgaauuuuuaaaaaacggcacucuaaccuauaaacaaacuaaaaaauuacucggauuaagugaugacuacgaauucaaaggagaaaagggaacuuacuucauagaauuuaaaaaauacaaagaguucauaaaagcauuaggcgaacauaaucuaagucaagacgaccuuaaugaaauagcuaaggauauaacucuaaucaaagacgaaaucaaacucaaaaaagccuuagcuaaauaugaccuuaaccaaaaccaaauagacagcuuaaguaaauuagaauuuaaagaccauuuaaauauauccuuuaaggcacuaaaauuaauaacaccccuuaugcuagaggggaaaaaauacgaugaagcgugcaaugaacuuaaucucaaaguagcuauaaaugaagauaaaaaagauuuccuaccagcauucaacgaaacauauuauaaagaugaaguaacaaacccaguaguauugagagcaauaaaagaauaucgaaaaguccuaaacgcacuuuuaaaaaaguacggcaaaguacauaaaaucaacauugaacucgccagagaaguuggaaaaaacuauagucaaagagccaaaauagaaaaagaacaaaaugaaaacuauaaagcuaaaaaagacgccgagcuugagugugagaaacucggacuaaagauaaauucaaagaacauauuaaaauuacguuuauuuaaagaacaaaaagaauucugcgcguauagcggcgaaaaaauaaagaucucugaucuacaagaugaaaaaauguuagaaauagaccauauauacccuuacaguagguccuucgacgacagcuacaugaacaaaguguuaguauuuacaaaacagaaccaagaaaaauuaaaucaaaccccguucgaagccuuuggaaacgacagcgcaaaauggcaaaaaauagaagucuuagcaaaaaaccucccaacuaaaaaacaaaaaagaauccuagauaaaaauuauaaagacaaggaacaaaaagauuuuaaagacaggaaccuaaacgauacaagauauauagcaagacuaguucucaauuauaccaaagacuauuuagacuuuuuaccgcuuagugacgaugaaaacaccaaguuaaacgauacucauaaaggaucgaaaguucacguagaagccaaaaguggaauguugacaagcgcguuaagacauacauggggcuuuucaacuaaagaucgaaauaaccacuuaagacaugcaauagacgcgguaauaauagcauaugccaacaacucuauagucaaagccuucagugauuuuaaaaaagagcaagaaucaaauuccgcagaacuauacgcgaaaaaaauuagugaauuagacuauaaaaacaaaagaaaauuuuuugaaccguuuucaggauuuagacaaaaaguacuugacaaaaucgacgaaaucuuuguaucgaaacccgagagaaaaaaaccauccggggcucuacaugaggaaacuuucagaaaagaagaagaguucuaccaaucuuacggaggaaaagaaggaguacucaaagcacuagaauuaggaaaaauacgaaaagucaacggaaaaaucguaaaaaacggcgauauguuuagaguagacaucuuuaaacacaaaaaaaccaacaaauucuaugccgugcccauauacacaauggacuuugcuuuaaaaguacuaccaaacaaagccguugcuagaagcaaaaagggugaaauaaaagauuggauccuaauggacgaaaacuaugaauucugcuucucucuauacaaagacucucuuauccuaauacaaacaaaagacaugcaagaaccagaguuuguauacuacaacgcauucacaaguucaacaguaagucuaauaguuucaaaacaugacaauaaauucgaaacccuaucaaaaaaccaaaaaauacuuuucaaaaacgcaaacgaaaaagaagugauugcaaaaucaaucggaauacaaaaccucaaaguauucgaaaaauacauuguaucagcucucggagaaguaacaaaagccgaauucagacaaagggaagacuuuaaaaaauga

SEQ ID NO: 4879 - RNA, 2955 nt, Artificial Sequence
  Cas9 variant
auggcacgaauacucgcguuugauauugguauuagcuccauuggaugggcauucucagaaaaugacgaacucaaagacugcggcgucaggaucuucacuaaaguagagaacccaaaaaccggagaaagccuugcacuaccuagacgacuagcacguagugcaagaaaaagacucgcacggcgaaaagcaagacuaaaucaucuaaaacacuuaauagcaaacgaauuuaaauuaaauuaugaagacuaccaguccuucgaugaaucacuagccaaagcauacaaaggaagccucauaagucccuacgaacucagauuccgggcauuaaaugaacuucuaucaaaacaagauuucgcacgagucauauuacacauugcaaaacgcagaggauaugacgacauaaaaaauucagacgacaaagaaaaaggagcaauacuaaaagcaaucaaacaaaaugaagaaaaacuagcaaacuaccaaucaguaggcgaauaccuauauaaagaauacuuucaaaaauucaaggaaaacagcaaagaauucacuaacguacggaauaaaaaagaaucauaugaaagauguauagcacaaucauuucuaaaagacgagcuaaaacuuauauucaaaaaacaacgagaauuuggauucucauuuagcaaaaaauuugaagaggaagugcugucaguugcauucuauaaaagagcucuaaaagacuuuagccauuugguaggaaacuguagcuucuucaccgacgaaaaacgagcaccuaaaaauagcccauuagcguucauguucguaacucuuaccagaauaauaaaccucuuaaauaaucugaaaaauacagaaggaauacuauacaccaaagacgaccuaaaugcucuacucaaugaaguuuuaaaaaacggaacguuaacauacaaacaaacaaaaaaacuacuaggacuaagcgacgacuacgaauucaaaggagaaaaaggaacauacuuuaucgaauucaaaaaauacaaagaauuuauaaaagcgcuuggcgaacacaaucuaagccaagaugaccuuaacgaaaucgcaaaagauauuacgcuaauuaaagacgaaauaaaacuaaaaaaagcauuagcaaaauaugaccuaaaccaaaaucaaauagauucacuuaguaaacuagaguucaaagaucaccuaaacauuucauucaaagcucuaaagcuaauaacaccauuaaugcuagaggggaaaaaauacgacgaagcaugcaaugaauugaaccucaaaguagccaucaacgaagacaaaaaagacuuucuaccagcauucaacgaaaccuacuacaaagacgaaguaaccaauccuguaguucuaagagcaauaaaagaauacagaaaaguccuaaacgcgcuccuaaaaaaauacggaaaaguacauaaaauuaacauagaauuagcaagagaaguaggaaaaaaucacucacaacgagcuaaaaucgaaaaagaacaaaacgaaaauuacaaagccaaaaaagacgcugaguuagaaugugaaaaauuagguuuaaaaauaaauucaaaaaacaucuuaaaacuacgccuauucaaagaacagaaagaguuuugcgcuuacucgggagaaaaaaucaaaaucagugacuuacaagaugaaaaaauguuagaaauugaucacauauauccauauucccguaguuuugacgacucuuacaugaacaaaguacuaguguuuacaaaacaaaaccaggaaaaacuaaauaaaacaccauucgaagcauucggaaaugauuccgcaaaguggcaaaaaauugaaguacuagcuaaaaauuuacccacaaaaaaacaaaaacgcauacuagacaaaaauuauaaagacaaagaacaaaaagauuuuaaagaccggaaucuaaacgauacaagauacaucgcaagacuaguacucaacuacacaaaggauuaucuugauuuucuaccucucucagaugacgaaaacacaaaauuaaacgauacacaaaaaggaucaaaagugcacguagaagcaaaaucuggcaugcuaacaucagcauuacgccauaccuggggauuuucaacuaaggacagaaauaaccacuuacaccaugcaauagaugcagucaucauagcuuacgcgaauaauucaaucgucaaagcauucuccgacuuuaaaaaagaacaagaaaguaacucagcagagcuuuacgcaaaaaaaauuucggaauuagacuacaaaaauaaacgaaaauuuuucgaaccauucagcgguuuuagacaaaaaguauuagacaagauagaugaaauauuugucucgaaaccagaacgaaaaaaaccaaguggagccuuacaugaagaaacuuuccgaaaagaagaagaauucuaccaaaguuauggaggcaaagagggcgucuuaaaagcauuagaauuaggaaaaauacggaaaguaaauggaaaaauagucaaaaacggcgauauguuuagaguagacauauucaaacacaaaaagacaaauaaauuuuaugcaguuccaauauacaccauggacuucgcucuaaaaguuuuacccaauaaagcgguagcaagaucaaaaaaaggagagauaaaagauuggauacuaauggaugaaaauuacgaauuuugcuucagccucuacaaggacaguuuaauacucauccaaaccaaagacaugcaagaaccagaauucguuuauuacaaugcguuuacaucaucaacaguaagccuaauuguaucaaaacacgacaauaaauucgaaacauuaucaaaaaaccaaaaaauauuauuuaaaaacgcaaaugaaaaagaaguaauagcuaaaucaaucggcauacaaaauuugaaaguauucgaaaaauauauuguaucagcacuuggugaaguaaccaaagccgaauucagacaaagggaagacuuuaagaaauga

SEQ ID NO: 4880 - RNA, 2955 nt, Artificial Sequence
  Cas9 variant
auggcaagaauacuagcguuugacaucggaauaucaucaauaggaugggcauucucggaaaaugacgaacuaaaagacuguggaguaagaauauuuacaaaagcggaaaaccccaaaacuggugaaucauuagcacuucccagaagauuagcaagaagugcuagaaaacgacuagcacgaagaaaagcaagauuaaaucaccuaaaacaucuaaucgcaaacgaauucaaacucaacuaugaagacuaucaaucauuugacgaaucacuagccaaagcauacaaagguucguuaauaagccccuaugaacucagauucagagcccucaacgaacuauuaaguaaacaagacuucgcucguguaauacuccacauagcuaaaagaagaggauacgaugacauuaagaacucagacgacaaagaaaaaggagcuauacuaaaagccauaaaacagaacgaagaaaagcuagcaaauuaccaaucaguaggcgaauaccuuuacaaagaauacuuccaaaaauucaaagaaaacuccaaagaauuuacgaacgugagaaacaaaaaagaauccuacgaaagaugcauagcacaaagcuuuuuaaaagacgaacuaaaacuaauauuuaaaaagcaacgagaauuuggauuuucauuuagcaaaaaguucgaagaagaaguacuaagcguugcauuuuacaaacgagcacucaaagacuuuucacaucucgucggcaauuguucguuuuucacagacgaaaagagagcacccaaaaacucaccacucgcuuucauguuuguagcguuaacaagaauaauaaaucuccuaaauaaccucaaaaacacggaagguauauuauauacaaaagacgaucucaacgcccuacucaacgaaguucuuaaaaaugguacacuaacuuacaaacaaacaaaaaaguuacuaggacuaagcgacgauuaugaauucaaaggcgaaaaagguacauacuucaucgaauucaaaaaauacaaagaauucauaaaagcuuuaggcgaucauucacuaucacaggacgaccuaaaugaaauagccaaagauauaacguuaauaaaagacgaaauaaaacugaaaaaagcgcucgcaaaauaugaccuuaaccaaaaccagauagacagccucaguaaauuagaauucaaagaccacuuaaauauuucauucaaagccuuaaaauuaaucacaccauuaaugcuagaagguaaaaaauaugacgaagccuguaacgaacuaaauuuaaaaguggcaauaaacgaagacaaaaaagacuucuuacccgcauuuaacgagacauauuauaaagacgaaguuacaaacccaguaguacuccgagcuauaaaagaauauagaaaaauauuaaacgcacuauuaaaaaaauauggaaaaguacacaaaauaaacaucgaauuagcgagagaagugggaaaaaaccauagucaaagagcaaaaaucgaaaaagagcaaaacgaaaauuauaaagcaaaaaaagacgcagaaauagaaugugaaaaacuggguuugaaaauaaacuccaaaaacauacuaaaauuaagauuauucaaagagcaaaaagaauucugcgcauauucaggcgaaaaaauaaaauuaagcgaucuucaagaugaaaaaaugcucgaaauagaccacaucuacccuuacaguagaucauucgacgacaguuauaugaacaaaguucuaguauuuaccaaacaaaaccaagaaaaacuaaacaagacaccauuugaagccuucggaaaugacagcacaaaauggcaaaaaauagaggucuuggccaaaaaccuaccagaaaaaaaacaaaagcguauacuagacaaaaauuacaaggacaaagagcaaaaagauuucaaagauagaaauuuaaaugauacaagauacauagcaagauuaguacuuaacuacacaaaggacuaucuagacuuucugccacuuagcgacgacgaaaacaccaaacugaaugauacacaaaaagguucaaaagugcacguagaagcaaaaucgggcauguuaacaucagcacucagacacaccuggggcuuuuccgcaaaagacaggaauaaucacuuacaccaugcaauagaugcagcuaucaucgccuaugcaaauaacuccaucguaaaagcauuuagcgauuucaaaaaagaacaagaaaguaauucgguagaacuuuacgcaaaaaagauaucagaacuagauuauaaaaacaaaagaaaauucuucgaacccuucucaggcuuuagacaaaaaguacucgacaaaauagacgaaaucuuuguaucaaagccagaacgaaaaaaaccaaguggagcuuuacaugaagaaacauucagaaaagaggaagaauucuaccaaaguuacggcggaaaagaaggcguauuaaaagcacuagaauuaggaaaaauucgaaaaguaaauggcaaaauaguaaaaaacggugacauguuuagaguagauaucuuuaaacacaaaaagacaaacaaauucuacgcaguaccaauuuacacgauggacuucgcauuaaaaguacuaccaaauaaggcagucgcccgcucaaaaaaaggcgaaauaaaagacuggaucuuaauggacgaaaacuaugaauucuguuucucauuauacaaagacucccugauacucauacaaacaaaagacaugcaggaaccagagcuugucuacuucaacgcuuuuacuuccuccaccguuagccuaaucguaucuaaacacgacaacaaauucgaaacacugaguaaaaaccaaaaaauacuguucaaaaaugccaacgaaaaagaggucauagcuaaaucaauagguauacaaaaucuuaaaguguuugaaaaauacauagucucagcguuaggagaagucacaaaagcagaauucagacaaagagaagacuuuaaaaaauga

SEQ ID NO: 4881 - RNA, 2955 nt, Artificial Sequence
  Cas9 variant
auggcaaggauacuggccuucgacauagguaucucgucuauaggaugggccuuuucagaaaaugaugaacuaaaagacugcggaguaagaauauuuaccaaaguagaaaaucccaaaacaggagagucacuagccuuaccacgacgucuugcgagaagcgcaagaaaaagauuagcgaggaggaaagcacgacuaaaucaccuuaaacauuuaauagcuaacgaauuuaaauuaaacuacgaagacuaccaaaguuuugaugaaaguuuggcuaaagccuacaaaggaagccucaucagucccuacgaacuaagauuuagagcccugaaugaacuccuuaguaaacaagacuuugcacgaguaauauuacacauagcaaaacguagagguuaugaugacauaaaaaacagcgaugacaaagaaaaaggagccauacugaaagcgauaaaacaaaacgaagaaaaauuagcaaacuaucagucggucggugaauaccucuacaaagaauauuuucaaaaauucaaagaaaauagcaaagaauucaccaauguaagaaacaaaaaagaaagcuacgaacgaugcaucgcacaaagcuuccuaaaagaugaauuaaagcuaauauucaagaaacaaagagaauucggauuuuccuucagcaaaaaauucgaagaagaaguacuaucagucgcuuucuacaaacgagcacuaaaagacuucagccauuuaguaggaaacuguagcuucuucacagaugaaaaacgggcaccaaaaaacagcccccuagccuucauguuuguugcgcuaacacgaauaauaaaucucuuaaacaaucucaaaaacacagaaggaauacuauauacaaaagaugaccuuaaugcauuacugaacgaagucuuaaaaaacgguacacuuacuuauaaacaaacuaaaaaacuacucggccuaagugacgacuaugaauucaaaggagaaaagggcacauacuuuauagaauucaaaaaauauaaagaauuuauaaaagcauuaggcgaacauaaucuaucccaagacgaucucaacgaaauagcuaaagauaucacuuuaauaaaagaugaaauaaaauuaaaaaaagccuuagcaaaauaugaccuaaaccaaaaucaaauagauucacuaucuaaauuagaauuuaaggaccauuuaaauaucucauuuaaagcccuaaaacuaauaacaccccuaaugcuagaaggcaaaaaguaugacgaagccugcaacgaacuaaaucuaaaaguagcaauaaaugaagauaaaaaagauuuucucccagcauucaacgaaacguacuacaaagacgaaguaacaaacccaguaguccuaagagccauaaaagaguauagaaaaguauuaaacgcacuacucaaaaaauauggaaaggugcauaaaauaaacauagaacuugcccgugaaguaggaaaaaaucauucucaaagagcaaaaauugaaaaagaacaaaacgaaaacuauaaggcaaaaaaagacgccgaacuugaaugugaaaagcuaggccuuaaaauaaauucaaaaaacauauuaaaacucagacuauucaaagaacaaaaagaauuuugcgcauacaguggagaaaaaaucaaaauaagugaucuccaggacgaaaaaaugcuggaaauagaccacaucuaccccuacagcagaaguuuugacgacucuuacaugaauaagguucuaguauuuacaaaacaaaaccaagagaaauuaaacaaaacaccauuugaagcauucggcaacgacucagcgaaauggcaaaaaauagagguucuagcaaagaaccugccaacaaaaaaacaaaaacguaucuuagacaaaaauuacaaagauaaagaacaaaaagacuucaaagacagaaaucucaacgacacccgauacauagcaagacuagugcuaaauuacaccaaagacuauuuagacuucuuaccacucucagacgacgaaaacacaaaacuaaaugacacacaaaaaggcucaaaaguccacguagaagcaaaaucaggaaugcuaacuucggcccuaaggcauacauggggauucucaacuaaagacagaaacaaccacuugcaccaugccauugacgcaguaauaaucgcauacgcaaacaacuccaucguuaaagcuuucagcgauuucaaaaaagaacaagaaucuaacucagcggaacuauacgcaaaaaaaaucucggaacuagacuauaagaacaaacgaaaauucuucgaaccauucagcggcuucaggcaaaaaguacucgacaagaucgacgaaaucuucguuucaaagccagaacguaaaaaaccgagcggagccuuacacgaagaaacauucagaaaagaagaagaauuuuaccaaucauacggaggcaaagaaggaguuuugaaagcacuggaacuugguaaaauacgaaaaguaaacggcaagauaguaaaaaacggagauauguuuagaguggauauauucaaacauaaaaaaacaaauaaauucuacgcaguaccaaucuauacaauggacuuugccuuaaaaguucuaccuaauaaagcggucgcucggucaaagaaaggagaaauaaaagacuggauuuuaauggacgaaaacuacgaauuuuguuuuucacucuacaaagacagucuaauauuaauucaaaccaaagauaugcaagaaccggaauuuguauacuacaacgcuuuuacaaguagcaccguaucccucauuguaucaaaacaugacaacaaauuugaaacccuauccaaaaaccaaaaaauacuauucaaaaacgcaaaugaaaaagaagucauagcaaaaucaauaggaauacaaaaccuaaaaguauuugaaaaguauauaguaucugcgcucggugaggucacuaaagcagaauuccgccaaagagaagacuuuaaaaaauga

SEQ ID NO: 4882 - RNA, 2955 nt, Artificial Sequence
  Cas9 variant
auggcccgcauauuagcauuugauauagguauauccucaaucggaugggccuucagugaaaacgacgaacuaaaagacugcggaguaagaauuuuuacaaaagcagaaaacccaaagacaggcgaaagccucgcguuacccagaagauuagcacgcucagcaagaaagagacucgcccgaagaaaagcucgacuaaaccacuuaaaacaucuuauagcuaaugaauucaaacucaacuaugaagauuaccaauccuucgacgaaucacucgccaaggcauacaaaggcaguuuaauuagucccuacgaauuacguuuccgcgcacuaaaugaacuccucuccaaacaagauuuugcucgggugauacuacauaucgccaaacgaagaggguacgacgauauaaaaaacucagacgacaaggaaaaaggagcaauacuaaaagcaauaaaacaaaaugaagaaaaauuagcaaauuaucaaucaguuggagaauaccuauacaaagaauacuuucaaaaauucaaagaaaauucuaaagaauucacaaacguaagaaacaaaaaagaauccuaugaaagaugcauagcacaaucauuccuaaaagaugagcuuaaauuaaucuuuaaaaaacaacgugaauuuggauuuucauucucaaaaaaauuugaagaagaagucuuaucaguagcauucuacaaaagggcucuuaaagauuucucacaccuaguaggaaacugcuccuuuuucacagaugaaaaacgagccccuaaaaacaguccacuagcauuuauguuuguagcacuaacuagaauaaucaaccuacucaauaaccuuaaaaauacagaagggauucucuauacaaaagaugauuuaaacgcccuauuaaacgagguccuaaaaaacgguacuuuaacauauaaacaaacgaagaaacuucuaggccuaagugacgacuaugaauuuaaaggagaaaaagguacauacuuuauagaauuuaagaaauauaaagaauuuauaaaagcacuaggagaccauagccuaucccaagaugaccuaaaugaaauagccaaggauaucacccuaauaaaagacgaaaucaaguuaaaaaaagcccuagccaaauaugaccuaaaucaaaaucaaauagauucacuaagcaaacucgaauucaaagaucaccuuaauauauccuucaaagcauuaaaauuaaucacuccuuuaaugcuugagggaaaaaaauacgaugaagccuguaacgaauuaaauuuaaaaguagcuaucaaugaagauaaaaaagauuuucugcccgcauucaacgaaacuuauuauaaagaugaggugacaaaccccgugguacuccgagccauaaaagaauaccgcaaaguccuaaaugcacuccuaaaaaaauacggaaagguacacaaaauuaacauagaacuagcaagagaaguaggaaaaaacuauagucaaagagcaaaaauagaaaaagaacaaaaugaaaacuacaaagccaaaaaagacgcagaacuagaaugugaaaaauuaggauuaaaaauaaacucaaaaaauauauuaaaacuucgacuauuuaaagaacaaaaagaguuuugugccuauucaggagaaaaaauaaaaauaucugacuuacaagacgaaaaaaugcuggaaauagaccacauauaccccuacagucgaaguuucgaugauuuuuacaugaauaaaguucuaguuuucacaaaacaaaaccaagaaaaguuaaaucaaacacccuucgaagcauuuggaaacgauagugcaaaauggcagaaaauagagguccuagccaaaaacuuacccacuaaaaaacaaaaacgaauacuagacaaaaacuacaaagacaaagagcaaaaagauuuuaaagacaggaaccuaaacgauacaagauauauagcucggcuugugcuaaauuacacaaaagauuaccuagacuucuuaccauuaucggacgacgaaaauaccaaacuaaacgauacccaaaaagguucaaaaguucacguugaagcaaaaaguggaauguuaacaucugcccucaggcauacauggggguuuagcgcaaaagaccgaaacaaccaccuacaccaugcaaucgacgcgguuauaauagcauaugcaaacaauucaauugucaaagcauuuuccgacuuuaaaaaagaacaagaaucaaacagugccgaacuauaugcaaaaaaaauuucagaacuagacuauaaaaacaaaagaaaauucuucgaacccuuuagcggauuuagacaaaaagucuuagauaaaauagacgaaauauuugucucgaaaccagaaagaaagaagccuuccggagcgcuacaugaagaaacauuuaggaaagaggaggaauucuaccaaucauauggcggaaaagaaggcguucuaaaagcacucgaacuaggaaaaauacgaaaaguaaauggaaaaauagucaaaaauggugacauguuucgcguagacauauucaaacacaaaaagaccaauaaauuuuacgcaguuccaauauacacgauggauuucgcacugaaaguauuaccaaauaaagcaguagcacgaaguaaaaaaggugaaauaaaagauuggauauugauggaugaaaacuaugaauucugcuuuucacucuacaaagacucacuaauacuaauacaaacaaaagauaugcaggaacccgaauucgucuacuacaaugcauuuacaucaucaacuguaucauuaaucguaucaaaacacgacaauaaauucgaaacacuaagcaaaaaccagaaaauacuauucaagaaugcgaacgagaaagaaguuauagcaaagucaauugggauucaaaacuuaaaaguauucgaaaaauacauaguaagcgcccucggagaaguaacaaaagcagaauucagacagcgcgaagauuuuaaaaaauga

SEQ ID NO: 4883 - RNA, 2955 nt, Artificial Sequence
  Cas9 variant
auggcaagaauacuugccuuugauauaggcauaaguucuauaggcugggcuuucucagaaaacgaugaacuaaaggauugcggagugaggauauucaccaaagcugaaaaucccaaaacaggagaaucauuagcacuuccaagacgacuugcuagaagcgcaaggaaacgauuagcaagaagaaaagcaagacucaaccaucugaaacaccuaauugcaaaugaauuuaaacucaauuacgaagacuaccaaucuuuugaugaaagccuagccaaagcauacaaaggaucgcuuauaagcccauacgaacuacgauucagagcuuuaaaugaauuacuaucaaaacaagacuuugcacgcguaauauuacacaucgcaaaaagacgaggauaugaugauauuaaaaacucagacgacaaggaaaaaggagcaauccucaaagcuaucaaacaaaacgaagaaaaacuagccaacuaucaaagcgucggugaauacuuauacaaagaauauuuucaaaaauucaaggagaauucuaaagaauucacaaauguacgaaauaaaaaagaauccuaugaaagaugcauugcacaaaguuuucucaaagacgagcugaaacuaauauuuaagaagcaaagagaauucggauuuucauucuccaaaaaauuugaagaagaaguacuaagcgucgccuuuuauaaacgggcucuaaaagacuuuagccaucuugucggaaacugcagcuuuuucacagaugaaaagagagcacccaaaaauucaccacuagccuucauguuuguugcucuuacuagaauaauaaaccuacuaaacaaucuaaaaaacacagaaggaauauuguacacaaaagaugaccuuaaugcccuucuaaaugaauucuuaaaaaauggcacauuaaccuauaaacaaaccaaaaaacuauuaggccucagcgacgauuacgaauuuaaaggagaaaaaggaacguacuuuauagaauucaaaaaauacaaagaauucauaaaagcgcuaggagaacauaacuuaagucaagacgacuuaaaugaaauagccaaagauauaacacugauaaaagaugaaaucaaauuaaaaaaagcucuagcaaaauacgaccucaaccagaaccaaauugacuccuugucaaagcucgaauuuaaggaucaccuuaacauuagcuuuaaagcauuaaaacuaaucacaccccuuauguuagaaggcaaaaaauacgaugaagcaugcaaugaauuaaauuuaaaaauugcaauaaacgaagacaaaaaagacuuccuuccagccuucaacgagacguacuacaaagacgaagucacaaacccaguaguauuacgagcaauaaaggaauacaggaaaguacugaaugccuuacuaaaaaaguacggcaaaguucacaaaauaaacauagaacucgcucgugaagugggaaaaaaccacagucaaagagcaaagauagaaaaagaacaaaacgaaaacuacaaggcaaaaaaagaugcugaacuugaaugcgaaaaauuaggacuaaaaaucaauucaaaaaauauucuaaaacuacgcuuauucaaggaacaaaaagaauucugcgcauauucaggagaaaaaauaaaaauuucagacuugcaagaugaaaaaaugcuagaaauagaccauauauaucccuacagucguuccuuugacgauuccuauaugaauaaagugcucgucuucacuaaacaaaaccaagaaaaacuaaaccaaaccccauucgaagcauuuggaaaugacagcgccaaauggcaaaaaaucgaaguucucgcuaaaaacuuaccaacaaaaaagcaaaagcgaauacuagacaaaaacuacaaagauaaagaacaaaaaaacuuuaaagauaggaaucuuaacgauacaagauacauugcaagacuuguacucaauuacacaaaagauuaucuagauuucuuaccauuaagcgacgaugaaaauacaaaacuaaaugacacccagaaaggaucaaagguccauguagaagccaaaucaggaauguuaacaagugcacuacgacacacauggggcuucagugcgaaagacagaaacaaucacuuacaccaugccaucgacgcaguaauuauagcuuacgcaaacaacuccauaguuaaagcauuuucagacuuuaaaaaagaacaagagagcaacucagcugaauuauacgccaaaaaaaucagcgaacuagacuauaaaaacaaacgaaaauucuucgaaccauuuagcggauuccgccaaaaaguuuuagacaaaauagaugagauauucguaagcaaacccgaacgaaaaaagccaaguggugcauuacacgaagaaaccuuuaggaaagaagaagaauucuaucaaucauaugguggcaaggaaggcguauuaaaagcacuagaauuggguaaaaucagaaaaguaaacggaaaaaucguuaaaaauggcgacauguucagaguagauaucuucaaacacaagaaaacaaacaaauuuuacgcaguaccaauauauaccauggauuucgcacuaaaaguucuaccuaauaaagcagucgccagaucgaaaaagggagaaaucaaagacuggauacuuauggacgaaaacuacgaauucugcuucagccuauacaaagacagucuaauacuaauacagacgaaagacaugcaagaaccagaauuuguauacuacaacgcauuuacaagcucaacaguaucuuuaaucguuucaaaacacgacaacaaauucgaaacuuuaagcaaaaaccagaagauccuuuuuaaaaaugcuaaugaaaaggaaguaauugcaaaaucaauaggcauacaaaaccuaaaaguauuugaaaaauauauagucagcgccuuaggagaaguaacuaaagcagaguuccgacaacgugaagacuuuaaaaaauga

SEQ ID NO: 4884 - RNA, 2955 nt, Artificial Sequence
  Cas9 variant
augguuagaaucuuagcauucgacaucggcaucucaaguauagguugggcauuuagcgaaaacgaugaacuuaaagacugcggaguccgaauauuuacaaaaguagaaaacccuaaaacaggagaauccuuggcguugccaagaagacuagcaagaucagcuagaaaaaggcucgcacgccgcaaagcuagauuaaaucacuugaaacaucuaauagcaaacgaauuuaaacuuaacuacgaagacuaucaaucauucgacgaaucauuagccaaagcauacaaaggaucauuaaucucaccauacgaauuaagauucagagcacuaaacgaacucuuaucaaaacaagauuucgcacgcgucauacuucacaucgcaaaaagaagaggauaugacgacaucaaaaauucagaugacaaagaaaaaggagcaauccuaaaagccaucaaacaaaaugaagaaaaacuagccaacuaccaaucaguuggagaauaucuauacaaagaauauuuccaaaaauucaaagaaaauuccaaggaguucaccaacgucagaaauaagaaagaaucauaugaacgcuguauugcccaaucauucuuaaaagaugaacuaaaauuaauuuuuaagaaacaaagagaauuuggauucaguuucaguaagaaauucgaagaagaaguacuauccguagcauucuacaaaagagcacuaaaagacuuuagccacuuaguaggaaacuguucauucuucacagaugagaaaagagcaccuaaaaacucuccacuagccuuuauguuuguagcccuaaccagaaucauuaauuuauuaaauaaccugaaaaauacggaagguauccuauacaccaaagacgauuuaaacgcucuacugaacgaaguacucaaaaacggaacacuaacguacaaacaaacaaagaaacuacuaggacucucagacgauuaugaguucaaaggagaaaaaggaacauauuuuaucgaguucaagaaauauaaagaguucauaaaagcacucggcgaacauaaccuuucacaagacgaccucaacgaaaucgcaaaagauauaacacugauaaaagacgaaauaaaacuaaagaaagcauuagcaaaauacgaccuaaaccaaaaucaaaucgacuccuuguccaaacuugaauuuaaagaccaccuaaacauuucauucaaggcccugaaacuaauuacaccccucauguuggaagguaagaaauacgaugaagcaugcaacgaacucaaccuaaaaguagcaauaaaugaagauaagaaagacuuccuuccugccuucaacgaaacguacuacaaagacgaaguaacaaauccaguaguacuaagagcaauaaaagaauacagaaaaguccucaacgcacuacuaaagaaauauggaaaaguacacaaaauaaauauugaacucgcaagagaaguagguaaaaaccauucgcaaagagccaaaauagaaaaagaacaaaacgaaaacuacaaagcuaagaaagacgcagaacuagaaugcgaaaaacucggauuaaaaauaaauucuaaaaacauccuaaaacuacgacuauucaaagaacagaaagaguucugcgcuuauucaggagagaaaauuaaaaucucagaucuacaagaugagaaaaugcuagaaauagaucacauauacccuuacucacgcucauucgacgacucuuacaugaacaaagugcucgucuucacaaaacaaaaccaagaaaaacucaacaaaacuccauuugaggcuuucggaaaugacucagcaaaauggcagaaaauagaaguacuagcuaaaaacuuaccaacuaagaaacaaaaacgaauccuagauaaaaacuauaaagacaaagaacaaaaagacuucaaagacagaaaucuaaaugacacgagauacauagcacgucugguacugaauuacacaaaagauuaucuggacuuccuaccacucagcgaugacgaaaacacaaaauugaacgauacacaaaaaggaucuaaaguacauguagaagcaaaaucaggaaugcuaaccucagcacuaagacacacauggggauucucaacuaaagacagaaacaaucaucuacaccacgcaauagacgcagugauuaucgcauaugcaaauaauucaauagugaaagccuucagcgacuucaagaaagaacaagaaaguaacucugcagaacucuacgcuaagaaaauaucagaacucgauuauaaaaacaaaaggaaauucuucgaaccauucuccggguucagacaaaaaguacuagacaaaauugacgaaauauucguaagcaaaccagaaagaaagaaaccaagcggagcacuucaugaagaaacauuuagaaaagaagaagaguucuaucaaucauacggaggaaaagaaggaguacuaaaagcauuagaacucggaaaaauacgaaaaguaaacggaaaaauagucaaaaacggcgauauguuuagaguagacauauucaaacacaagaaaaccaacaaauucuacgcaguacccaucuauaccauggacuucgcguugaaaguauuacccaauaaagcaguagcaaggagcaagaaaggagaaauaaaagauuggauacuaauggaugaaaauuaugaauuuugcuucucauuauacaaagauucuuuaauauuaauacaaacaaaagacaugcaggaaccagaguucguauauuauaaugcauucacaucuucaacuguaagccuaaucgucuccaaacacgauaacaaauucgaaacucucagcaaaaaucagaaaauacuguucaaaaacgcaaacgaaaaagaaguaauagcuaaaucaauaggaauacaaaaucuaaaaguauucgaaaaauacauuguaucagcuuuaggagaaguaaccaaagcugaauuuagacaaagagaagacuucaagaaauga

SEQ ID NO: 4885 - RNA, 2955 nt, Artificial Sequence
  Cas9 variant
auggccaggauauuagcuuucgauauaggcauaagcagcaucggaugggcguuuagugagaaugaugagcucaaagacuguggcgugcgcauauucacaaaagcagaaaacccuaaaaccggcgaaagcuuagcccuaccaagacggcuugcuagaagcgccagaaaaagauuagcuagacgaaaagcaagacuaaaccaucuaaaacacuuaauagccaacgaauuuaaauuaaauuacgaagauuaccaaucauucgaugaaucgcuagcaaaagcguauaaaggaucguuaauaagcccauaugaacuucgauuccgagcacuuaaugaauuauuaucaaaacaagacuuugccagaguaauauugcauauagcaaaaagaagaggauaugaugacauaaaaaauagcgaugacaaagaaaaaggagcuauccuaaaagcaauaaaacagaaugaagaaaagcuagcaaacuaccaauccguaggagaauaucuuuacaaagaguacuuccaaaaauuuaaagaaaauucuaaagaauucacaaacgugagaaauaaaaaagaaucauaugaacgauguauagcucaaucauucuuaaaagaugaacuaaaacuuaucuucaaaaaacaacgagaauuuggauuuucguucucaaaaaaauucgaagaagaaguuuuaucagucgccuucuacaaacgugcuuuaaaggauuuuucacaucuuguaggcaacuguucuuucuucacagacgaaaagcgcgccccaaagaauaguccacuugcguucauguucgucgcgcucacaagaaucauaaaccuccuuaauaacuugaaaaacacagaaggcauuuuauacacgaaagaugacuuaaacgcacuucuaaacgaaguccuaaaaaacgggacucucacuuacaaacaaaccaaaaaacuccuaggacugucugacgauuacgaauucaaaggugaaaaaggaaccuacuuuauagaauucaaaaaauacaaagaauuuauaaaagcccuaggcgaucacuccuuaucgcaagacgaucuaaaugaaauagccaaagauauuacccuaauaaaggaugaaauuaaacuaaaaaaagcauuagcaaaguaugaucuuaaucaaaaccaaauugacucacuaucaaaacuagaauuuaaggaucaccuaaauauaucguucaaagcauuaaaacuuaucaccccauuaauguuggaaggaaaaaaauacgacgaagcgugcaacgaauuaaauuuaaaaguagcaauaaacgaggauaaaaaggacuuccuacccgcauucaacgaaacauacuacaaagaugaagugacaaauccuguaguauuacgagcuauaaaagaauauagaaaaguccuuaacgcgcuacuaaaaaaauauggcaaaguacauaaaauaaacaucgaauuagcaagggaaguuggcaaaaacuauucucaaagggcaaaaauugaaaaagaacaaaacgaaaacuacaaggcaaaaaaggacgcagaacuugaaugcgaaaaacucggccuaaaaauuaauucuaaaaacauccuuaaacuaagacuuuucaaagaacaaaaagaauuuugugcauacucaggugagaaaaucaaaauaucagaccuacaagaugaaaaaauguuagaaauagaucauauuuacccguauucaagaucauucgacgauucauacaugaauaaaguauuagucuucacaaaacaaaaccaagaaaaacuaaaucaaacuccauucgaagcauuuggaaaugacagcgcaaaauggcagaaaauagaaguauuagcuaaaaauuuaccaacaaaaaaacaaaaaagaauuuuagauaaaaauuauaaagauaaggaacaaaaagacuuuaaagacagaaaccuaaacgacacccgguacauagcacgauuaguacucaauuacacuaaagacuaccuagacuuucucccacuaucagacgaugaaaauacaaaacuaaaugacacucaaaaaggaucaaaaguccacguagaagcaaaaucaggaaugcucacaucagcacugcgucauaccuggggcuucucggcaaaagaccgaaacaaccaucuacaccacgcaauugaugcaguaauaaucgcauaugcaaauaacuccaucgucaaagcauucagcgacuucaaaaaagaacaggaauccaauagcgcagaacuauaugccaaaaaaauauccgaauuagacuacaaaaacaaacgaaaauucuucgaacccuucucaggauuuagacaaaagguacuagauaaaauagaugaaauauucguaaguaaaccagagcgcaaaaaaccaagcggugcacuacacgaagaaaccuuucgaaaagaggaagaguucuaucaaagcuauggaggaaaagaaggcguacuuaaagcguuagaacuagguaaaauacgaaagguaaacggaaaaauaguuaaaaacggcgacauguuucgaguagacauauuuaaacauaaaaaaacaaacaaauucuaugcaguaccaaucuacacaauggauuuugcguuaaaaguauuaccaaacaaagcgguagcacgauccaaaaaaggcgagaucaaagacuggauauuaauggacgaaaauuacgaauucuguuucagcuuauauaaagacuccuuaauuuuaauacagaccaaagacaugcaagaaccagaauuuguauauuauaacgcuuuuacaucauccacuguuucauuaauaguaucuaaacaugacaauaaauuugaaacccuaucaaaaaaucaaaaaauuuuauucaaaaacgcaaaugaaaaagaaguaaucgcaaaaucgaucgguauccagaacuuaaaaguauucgaaaaauacaucguauccgcccuaggugaaguuacaaaagccgaauucagacaaagggaagacuucaaaaaauga

SEQ ID NO: 4886 - RNA, 2958 nt, Artificial Sequence
  Cas9 variant
auggcaaaaauacuagcguuugacauuggaauaucgucaauaggaugggccuucguagaaaaugaugagcucaaagacugcggaguccgaaucuuuacuaaggcagaaaaccccaaaacaggggaaaguuuagcacuaccccgaagacuugcccgcucagcuagaaagagacuagcgcgaagaaaagcuagacucaaucaccucaaacaccugauagcaaaugaauucaaacuuaacuacgaagacuaccaaucuuuugacgaaucacucgcaaaagcauauaaagggacacuaauaaguccauaugaacuacgauucaaagcauuaaacgaauuauuaucaaaacaagaccuagcaagaguaaucuuacauauagcaaaaagaagaggauacgauaacauaaaaaacuccgacgacaaagaaaaaggagcaauucucaaagcaguaaaagaaaacgaagaaaagcuagccaauuauaaauccguaggagaauaucuauacaaagaguauuuccaaaaauuuaaagaaaauagcaaagaauucauaaacguucguaacaaaaaagaaagcuacgaaagaugcauagcacaauccuuccuaaaagacgaauuaaaauuaauauuccaaaaacaaagagaauucggcuuuaacuucaguaaaaaauuugaagaagaaguauuaagcguagcauucuauaaacgagcauuaaaagacuucucacaccuuguagguaauuguucuuuuuucguagacgaaaaacgcgcgccaaaaaauucaccacuagccuucgaauuuguugcacuaacacgaauaguaaaucuacucaauaaccucaacaaaaauaauucauacauaaaagacgacuuaaacgcacuucuaucagagguccucaaaaacggcacacuaacauacaagcaaacuaaaaaaauccuaggauuaucagacgacuacgaauuuaaaggccaaaaaggcaauuacuuuaucgaauuuaaaaaauacaaagaauucauaaaagccuuaugcgaacauaauuuaaaucaagacgaucuaaaugaaauagcuaaagacauaacucuggucaaagacgaaacaaaauuaaaaaaagccuuggcgaaauacgacuuaaaccaaaaccaaauagaaaaucuuucuaaaauagaauucaaagaccauuuaaauauaaguuucaaagcacuaaaauuaaucguaccacugaugcgagaaggaaaaaaauaugaugaaguuugcaacgaacucaaccucaaaacagcaaucaaugaagauaaaaaagaguuuuuaccagcuuuuaaugaaacauauuacaaagacgaagugaauaacccggucguacuacgagcuaucaaggaauacagaaaaguccuaaacuccuuacugaaaaaauacggcaaaguacacaaaauaaauauagagcuagccagagaaguuggaaaaaaucacagagaacguucaaaaauagaaaaagaacaaaaugaaaauuuuaaagcaaaaaaagacgcagaacuggaaugcgaaaaauuaggucuaaaaauaaacaguaaaaauaucuuaaaauuacgcuuauucaaagaacaaaaagaauucugcgucuacagcggagaaaaaauaaaaaucucagaccuucaagacgaaaaaaugcuagaaauagaccacaucuacccuuauagcagaucauucgacgauagcuacaugaacaaaguacuagucuuuacuaaacagaaucaagagaaacuaaacaaaacaccauucgaggcauucggaaaagacgauguaaaguggcaaaaaaucgaaacucuagccaaaaacuugccagcgaaaaaacaaaagcgaauccuagacaaaaacuacaaagacaaggaacaaaaagauuucaaagacaggaaccucaaugacacccgauauauagcacgacuaguacugaacuacacuaaagauuaucuagaauuucuaccauuaucagaugacgaaaauauaaaacucaacgacacacaaaaaggauccaaaguacaugucgaagcaaaaucgggaauguuaacaucaguacuaagacacacauggggauucucgacaaaggacagaaacaaucaccuacaccaugccauagacgcaguaauaauagccuacgcaaaugcaaguguaguaaaagccuucucagauuucaagaaagaacaagaaaauuacacagcagaauuauacgcaaaaaaaaucaacgaacucgacuucaaaaauaaaaggaaauuuuuugagcccuucucaaacuucagacaaaaaguacuagaaaaaauagaugaaauauucguaaguaaaccugaaagaaaaaaacccuccggcgcauuacaugaagaaacauucuacaaagaagaagaauucuacaaagaguauggaggaaaagaagggguauuaaaagcacuagagcuaggaaaaauacgaaaagucaacggcaaaaucguuaguaacgcuaacauguuuagaguagauauuuucaaauauaaaaagacgaacaaauucuaugcaguacccauuuacacaauggacuuugcacucggcauuuuaccaaacaaagcaguagucggagguaaagacaaacaaggaauaauaaaagauuggcuuuuaauggacgaaaauuaugaauuuugcuuuucacuauacaaagauagccuaaucuuguuacagaccaaggacaugcaagagccagaacuagucuacuucaaaucauucaaaaguucuacagcaggacuaguaguaucaaaacacgacaacaaauucgagaauuuaaaugaaaaccaaaaaaagcuauuuaagucagcuaacgaaaaaaaagucgucgcagagggaauaggaauacaaaacuuaaaaguuuucgagaaauacauaguauccgcacucggugaaauaacaaaggcagaaauaaaagaaagagaaaacuucaaaaaaaaauga

SEQ ID NO: 4887 - RNA, 2961 nt, Artificial Sequence
  Cas9 variant
augccaagcgauccagcagaagccaaaccauuagaauuauuggauccauaugccuugagggcacaaggacuagaccaagcauugccccucacacacuuugguagagcccucuuccaucuaaaucaacgaagagguuucaaaaguaaucgaaagacagaucgaggcgauaacgaaaauggaaaaaucaaagaugcgucacaacguuuagacugggcaaugcaugaagcaaaagcaagaacauauggagaguuuuuacaucuaaggagacaaaaagcaccagacccuagacaaguuccaacaguacguacaaggcucucagucgguaaaagaggaggaccagaugcaaaagaagaagcuggauaugacuuuuacccagauagaaggcauuuggaagaagaauuucaugaacuaugguccgcacaagcacaauuucaucccgaacucacacaggaccuacgcgacuugguauucgaaaagauauuuuaucagcguccucuuaaagaaccuaaagucgguuuauguuuauucacuucagaagaaagauuagcgaaagcccauccauuaacacaacgacgaguuuuguacgaaacaguaaaucaauuaaggauaacagcugauggaagaagcguuaggccacuaaguagggaacaaagagaucaaauuaucuuggcacuagacacaaagaaaccuacaaaaucacuuaacucaaugguaguaacacugcaagcccuuggaaaaguacuuaaauuacgagaaggagaaagguucacucuagaaucaggcguaagagaggcuauagcaugcgacccagugcgggcagcaaugcuugcaacauucgguccaagauggucagcacuugauuggccagaacaauggcaaguuauaucaagagugagaaaacuacaagaugacaaagauuuugcugagcuagucgaaugguuaauagaauuguacggaguagacaaagaagcagccguaaaaaucgcaaauacccacuuaccagaaggauauggaagacuaggacugacggcaacgacaaggauauuggaucggcuaaaaucaaauguauuuacauacgcacaagcaguagcugcauguggauggcaucauuccgaccagagaacaggagaaugccuagauagacuaccguacuauggagcaguuuuagauagacacgucauaccaggcacauaugacgaaaaugaugaugacaucacaagauuuggaagaauaacaaauccaacuguucauaucggacuaaaucaacuccgaaggcuaguuaauaaaauuauagaaguuuacggcaaaccaaaccaaauaguaguagaacuugcacgagaauuaaaacaaagugaacaacagaaaaacgacgcaauaaaauuaauaagagacacaacaacagcagcaaaacaaagaucagaaaaauuagaagaauugggaauaacagacaacgguagaaauagaauguuacuaagacuaugggaagaccuaaacccagacgaugcaaugagaagauucugcccauacaccggacaaaggauauccgcagcaaugaucuucgauggaucuugcgauguagaucauauacuaccuuauucaaggacucuagaugaugguuucgcaaauagaacacuaugucuaagggaggcaaaccgagaaaaacguaaccaaacuccaugggaagcauggggaggaacuccgaauugggaagcaauagaaacaaaucuaaagaauuuaccugaaaauaaaagauggagauuugcgccagaugcaauggcaagguuugaaggagaaaacgacuuccucgauagagcucugguagacacgcaguaccuagcaagaauaaguagaacauaucuagauacccuauucacagaagguggccacguguggguaguaccaggacgcuugacagaaaugcuuagaagacacuggggccuuaacucuuugcuaacagauaaagauagaggugccguaaaaagcaaaaaccgaacagaccauaggcaccauaguauagaugcagcaguaguagcugcgacugacagaaguuuacuuaauagaauaucgcgagcagccggucaaggagaaguagcaggacagagugcagaauuaauugcaagggagacuccaccaccuugggaagguuuccgaaaugaucuaaaaagucaacuaggaagaauuauuguaagucacagagcagaucauggacggauagacagacaagcaagaaaacaaggacgggacucuacagccggucaacuacaucaagaaacagcguacuccauaguugaugauacaagaguagcaagcagaaucgacuuuuuaaguguaaaaccagcacaguuacuugaccaaccagguagaucaggacagguaagggaucuacaauuaagaaaagcguuacgaguagcuacaggcgaccugaccggaaaagacuacgagaaagcacuaagggauuucgcugcaaaaccagguccauauaaagguauaaggagaguacgaauaauaaaacccuugcaagaacaagcgcgagugcccgucccaguucuugaccccauaaaagcauaccagggaggaucaaaccauguauucgaaauauggcauuuaccagacggcaagguagaaccacaagugauaaccucauuugaagcacaugcguuagaaguggaaaagcguccacacccugcagcuaaaagacuauuaagaguacauaaaggcgauaugguagcacuaaaacgugaaggaagaacaguaguaggacacguucaacagaugcauauuaaaaaugguuuauucauaguuccgcauaaugaagcuaaugccgaugccagaaauucugacaggacagacccuuuuaaauggauucaaauugcugcucagccagcaauagcagcagguauacgucguguggcaguggacgaaauagggagguuaagagauggcggagcaaaaacaauauga

SEQ ID NO: 4888 - RNA, 2964 nt, Artificial Sequence
  Cas9 variant
auggcaagaauucuagcauuugacauaggaaucucauccauaggcugggcguucucugaaaaugacgagcucaaagauugugguguuagaauauucacaaaagcagaaaaccccaaaaccggcgaaucauuagcacuacccagacgacuaucuagaagcgcuagaaagcgccuggcacgaagaaaagcaagacuuaaccauuuaaaacaucugauugcaaaugaauucaaauuaaauuaugaagacuaucaaagcuuugacgaaagccuagccaaggcguauaaagggucacuuauaucaccauacgaacuaagauucagggcucuaaacgaauucuuaucaaaacaagacuucgcaagaguaauacuccauauagcaaaacguaggggguaugacgacauaaaaaauaacggagaugaggaaaagggcgaaauacuuaaagcaaucaaacaaaaugaagaaaaguuagucucauaccaaucaguaggugaguaccuauacaaagaguauuuucaaaaauucaaagaaaacuccaaagaauucauaaauguccgaaauaaaaaagaaucauacgaacgauguaucgcacaaucauuucuuaaagacgaacuuaaauuaaucuuccaaaaacaacgagaauucggauucagcuuuucuaaaaaauuugaggaggaaguauuaucaguagccuuuuacaaacgcgcauuaaaagacuuuagccacuugguaggaaauugcucauucuuuacugacgaaaaacgagcgccaaaaaauucgccauuagcauucauguucguugcauuaacccgaauaauaaacuuacuaaacaaucuaaaaaauacggaaggaauacuauauaccaaagacgaccugaauacgcuacuaaacgaaguauuaaaaaacggaacucuaaccuacaaacaaacuaaaaaauuacuaggauuauccaacgacuaugaauucaaaggagaaaaagguacauauuuuaucgaauuccagaaauauaaagaauuuguaaaagccuuaggagaacacaaucugagucaagacgaucuaaaugaaauugcaaaagacaucacccuaauaaaagacgaaauaaaauuaaagaaagcucuagccaaauacgaccuaaaccaaaaucaaauagauucccugagcaaacuagaauuuaaagaccaucuaaauauaagcuuuaaggcccuuaaacuaauaacuccucuaaugcuagaagguaaaaaguaugacgaagcguguaacgaacuuaaccuaaaaguagcuauuaaugaagauaaaaaagauuuuuuaccggcauucaaugaaacauauuacaaagaugaaguaacuaacccaguaguacucagagcaaucaaagaauauagaaaaguacucaaugcucugcucaaaaaauacggaaaaguucacaaaaucaacauagaacuagcaagagaagucggaaaaaaccauucccaaagagcaaaaauugaaaaagaacaaaaugaaaacuauaaagcuaaaaaagaugcagaacuugaaugugaaaaauuaggacucaaaaucaacucaaaaaacauacuaaaacuacgacuauucaaagaacaaaaagaauuuugcguuuauaguggagaaaaaauuaaaauauccgaccuacaagaugaaaagaugcucgagauagaccauauauauccauacaguagaucauucgacgauuccuauaugaauaagguucuagucuucacaaaacaaaaccaagaaaaauuaaauaaaacaccauucgaaaccuucgguaaugaucgcgucaaauggcaaaaaauugagguacucgccaaaaaucuaccaacgaaaaaacaaaagcgcauauuagauaaaaacuacaaagacaaagaacagaaagacuucaaagacaggaaccuaaaugacacaagguacauagcaaggcuuguacuaaacuacacaaaagacuaccuagacuuucuaccacuaucagacgacgaaaauaccaaauuaaacgauacccaaaaagguaguaaaguacacguagaagcaaaaucgggaaugcuaacaaguacguuacgacacacuuggggauucaguaccaaagaucgagauaaccauuuacaccacgcaauugacgcagcaauaauagccuaugcuaacaauaguauaguaaaggccuuuuccgacuuuaaaaaagaacaagagucaaacacagcugaacuauacgccaaaaaaauuucugagcuagacuacaaaaacaaaagaaaauucuuugaaccauucagcggcuuuagacaaaaacuauuagauaaaauagaugaaaucuuuguaucaaaaccagagcggaaaaaaccaagcggggcucuucaugaagaaacguucagaaaagaagaggaauucuaccaauccuacggcggcaaagaaggaguucuaaaagcacuagaacuaggaaaaaucagaaaaguaaacgguaaaauggugaaaaauggagauauguuccguguugacaucuuuaaacauaaaaaaacuaacaaauucuaugcaguaccaauuuauacaauggauuuugcacucaaaguacuaccaaauaaagcaguaguccaaggaaaagacaaaaaaagcggacuaauuaaagacuggauucugauggaugaaaacuaugaauuuuguuucucacuauauaaagacucacuaauccuaauacaaacaaaggacaugcaagagccagaacuuguauauuaugaaagacuagacucuagcaacgccucauuaacgguuucaaaacaugauaauaaauuugaaacauuaagcaaaaaccaaaaaauauuauucaaaaacgcaaacgagaaagaagucauagcgaaauccauaggaauccaaaacuuaaaaguauuugaaaaauauaucgugagcgcccucggcgaagucacuaaagcagaauucagacaacgagaagacuuuaaaaaauga

SEQ ID NO: 4889 - RNA, 2964 nt, Artificial Sequence
  Cas9 variant
auggcacgaauucucgcauucgacauuggaauaagcuccauaggaugggcauucucagaaaacgacgagcucaaagauuguggcguaagaaucuucacaaaagcagagaaccccaaaacaggagaaucauuagcauuaccaaggagacucgccagaagcgcccgaaaacgucucgcaagaaggaaggccagauuaaaccaccuaaaacaucuuauagcaaaugaauucaaacuaaauuacgaagacuaucaaaguuucgacgaaucacuggcgaaagcauacaaagggagccucaucucaccauacgaacucagauucagagcauuaaaugaacuacucuccaaacaagacuucgcaagaguuauacuacacauagcaaaaagacgaggauaugacgacauaaaaaacucagacgauaaagaaaagggagccauauuaaaagccauaaaacaaaaugaagaaaaauuagcaaacuaccaaucaguaggagaguaucuauacaaagaauacuuccaaaaauucaaagaaaacuccaaagaauucacaaacguaagaaacaaaaaagaauccuacgaacguuguaucgcccaaaguuuuuuaaaagacgaauuaaaacucauuuucaaaaaacaaagagaauucggcuuuaguuuuagcaaaaaauuugaagaagaagucuuaaguguagcauucuauaaaagagcauuaaaagacuucucucaucucgugggaaacuguuccuucuucacugacgaaaaaagagccccaaaaaauucaccuuuagcauuuauguuuguagcccuaacaagaauaauuaacuuacuaaacaaccuaaaaaacacagaaggaauacuauacacaaaagaugacuuaaacgcauugcuuaacgaaguauuaaaaaacggaacauuaacauacaagcaaacaaaaaaacuucuaggacuauccgacgauuaugaauucaaaggcgaaaaaggaaccuacuuuaucgaauuuaaaaaauacaaagaauucauaaaggcacuaggagaccacucccugucucaagacgaucucaacgaaauagcuaaagacaucacucuuauaaaagaugaaauuaaacucaaaaaagcauuagccaaauacgauuugaaucaaaaucaaauagauagucucaguaaacuagaauuuaaagaucaccuaaacauaaguuucaaagcauuaaaacuuauaacgcccuuaaugcucgaaggaaaaaaauacgaugaagcuugcaaugaacuuaaucuaaaagucgcaauuaacgaagauaaaaaagauuuucucccagcguucaaugaaaccuacuacaaagacgaaguaacgaauccaguaguucucagagcgauaaaagaauaucgaaaaguucucaaugccuuacuaaaaaaauacggaaaaguccacaaaauuaacaucgaacuagcaagagaaguagggaaaaauuauucacaaagagcaaaaauugaaaaagaacaaaaugaaaauuacaaagcuaaaaaagacgcugaacucgaaugcgaaaaacuuggcuuaaaaauuaacucgaaaaacauacucaaacuacgacuauucaaagagcaaaaagaauuuugcgcauauucgggugaaaaaaucaagaucucugauuuacaagaugaaaagaugcuugaaauagaccacauauauccauauagcagaucauucgaugacagcuauaugaacaaaguucucguuuucacgaaacaaaaucaggaaaaacuaaaucaaacaccuuuugaagcauucggaaacgacucugcuaaauggcaaaaaauagaaguacuugcaaaaaaccuuccaaccaaaaaacaaaaaagaauccuugacaagaauuacaaagacaaggaacaaaaagacuucaaggaucgaaacuuaaacgacacucgcuauaucgcucgucucgucuuaaacuauacaaaggacuacuuagauuuucucccacucucagaugacgaaaacacaaaacuaaaugacacacaaaaaggaucuaaaguacauguagaagcaaaaucaggcaugcucacuucagcauuaaggcauacauggggauucucagcuaaggaccggaauaaccaccuacaccaugcaauagaugcaguaaucaucgccuacgccaacaacagcauaguaaaagcuuucagugacuucaaaaaagaacaagaaucuaacagugccgaacucuaugcaaaaaaaauuagcgaacuggacuacaaaaauaaaagaaaauucuucgaaccauucucaggauuccggcaaaaaguacuagacaaaaucgacgaaauauucguaucaaaacccgaaagaaaaaaacccaguggcgcccuacacgaagaaaccuucagaaaagaagaagaauuuuaucaaucauacggaggaaaagaaggagugcuaaaagcguuagaacuaggaaaaaucagaaaaguaaacgguaaaauaguaaaaaauggcgacauguuccgagucgauaucuuuaagcacaaaaaaaccaacaaauucuaugcagugccaauauauacaauggauuuugcacuaaaaguuuuaccuaacaaagcuguggcacgaucaaaaaaaggagaaaucaaagauuggauauuaauggaugaaaauuacgaauucugcuuuucguuauauaaagacucacuaauacuuauccaaacuaaggauaugcaagaaccagaauuaguauacuuuaacgcauucacuucaucaacaguaucauuaauaguaaguaaacacgauaacaaauuugagacacuaagcaaaaaccaaaaaauacucuuuaaaaaugccaaugagaaagaagugauagccaaaucaauaggaauacaaaaccuuaaaguuuucgaaaaauacaucguaagcgcacuaggagaagucacaaaagcagaauuccgccaaagagaagauuucaagaaugaauuacgauga

SEQ ID NO: 4890 - RNA, 2964 nt, Artificial Sequence
  Cas9 variant
auggcaaggauccuggcauucgacauaggaauaagcucaaucggaugggcauucagcgaaaaugaugaauuaaaagacugcggcguacgcaucuuuacaaaagccgaaaacccaaaaacaggagagagcuuagcccucccacgccgacuugcaagaagcgcacguaaacgauuagcuagaagaaaagcaagauuaaaccauuuaaaacauuuaauagcuaaugaauuuaaacuaaauuacgaagauuaccaaucuuuugacgaaucuuuagcaaaagcauacaaaggcucacucauaaguccuuacgaacucagauucagagcccuaaacgaacuauuaaguaaacaagauuucgcgcggguaauccugcauauagccaaaagaagaggauaugacgacauuaaaaauaauggcgacgaagaaaaaucagaaauacucaaagccauaaaacaaaaugaagaaaaacucgugaacuaucaaagcguuggagaauauuuauacaaagaauauuuucaaaaauucaaagaaaacagcaaagaauuuauaaauguaaggaacaagaaagaaagcuacgaacgguguauagcacaaaguuuucuaaaagaugaacuaaaauuaauauuucaaaaacaaagagaguucggauucucauucucgaagaaauucgaagaagaaguauuaagcguagcauuuuacaaacgcgcacuaaaagacuuuucucaucuaguaggcaacugcucauuuuucacggacgaaaaacgagcacccaaaaacuccccauugguauucauguuuguagccuuaacgagaauaauaaaccugcuuaauaaucucaaaaauacagaaggaauauuauacacaaaagacgacuugaacgcauuacucaaugaaguacuaaagaaugguacacuaacauacaaacaaacaaagaaauuauugggccucagugacgauuaugaguucaaaggugaaaaaggcacauacuucauagaguucaagaaauauaaagaguucaucaaagcgcucgacgaacacagcuuaucacaagacgauuuaaacgaaauagcaaaagacauuacccuaauaaaagacgaaauuaaacuaaagaaagcacucgccaaauacgaccuaaaagaaaaucaaauugauucauuaucaaaacuagaauuuaaagaccaccucaacaucagcuucaaagcucuaaaauuaauaacaccauuaauguuagaaggcaaaaaguacgaugaagcaugcaacgaacuaaaucucaagguugccauaaacgaagacaagaaggauuuccuaccagcauucaacgaaacauauuacaaagacgaaguaaccaauccaguaguacuccgcgcuauaaaagaauauagaaaaauauuaaacgcucuauuaaagaaauacggaaaaguucauaaaauaaauauugaacuagcacgcgaaguagguaaaaaccacucgcaacgagcuaaaaucgaaaaggaacaaaacgaaaauuauaaagcaaagaaagaugcagaacucgaaugcgaaaaauugggcuuaaaaauaaauucuaaaaacauccuaaaacuaagacuauuuaaagaacaaaaagaauuuugcguauacucaggcgaaaagaucaaauuaucagacuugcaagaugagaaaauguuagaaauugaucauaucuacccuuauagcaggagcuucgacgacucauacaugaauaaaguauuaguauucgccaaacaaaaccaagaaaaacuaaauaaaaccccauucgaagcauucggaaaugacucaacgaaauggcagaaaauagaaguccuaacuaaaaaccuaccaacaaagaaacagaaaagaauccuagacaaaaacuacaaagacaaagaacaaaaagacuucaaagacagaaaucuaaaugauacacgauacauagcacgacucguccuaaauuacaccaaagauuacuuagauuuccuaccacuaucagacgacgaaaacacaaaacucaacgauacacaaaaaggcaguaaaguacauguggaagcaaaaucaggaauguuaaccagugcauuaagacacacguggggauucaguacuaaagaccgaaauaaccaucuccaccacgccauagacgcaguaauaauagcuuaugcgaacaacaguauaguaaaagcauuuuccgacuuuaagaaagaacaagaaagcaacagcgcagaacuauacgccaagaaaauaagugaauuggacuauaaaaacaaaagaaaauuuuucgaaccauuuagcggauucagacaaaaaguacuagacaaaauagacgaaauuuucgucucuaaaccagaacgaaagaaaccaucgggcgcacuacacgaagaaacuuucagaaaagaagaagaguucuaccaauccuacggcggaaaagaagggguacucaaagcauuagaauuaggcaaaauaagaaaaguaaacggaaaaauagugaaaaacggcgacauguuucguguagacauauucaaacauaagaaaaccaacaaauucuacgcaguacccauauacacaauggauuuugcacuaaaaguacuacccaacaaagcaguagcgcgaucuaagaaaggagaaauaaaagacuggauucugauggacgaaaacuaugaguucugcuucuccuuauacaaagauucucuaauccuaauacaaacaaaagauaugcaagaacccgaacucguauauuucaaugcuuuuacaaguagcacaguuagcuuaauaguaagcaaacacgacaacaaauucgaaacauuaaguaaaaaucaaaagauacuauuuaaaaaugccaacgaaaaagaaguaauagcgaaaucaauaggaauacaaaaccuaaaagucuucgaaaaauacauuguaucagcacuuggagaaguaacaaaagcagaauuucgacaacgcgaagacuuuaaaaacgaacuccgauga

SEQ ID NO: 4891 - RNA, 2964 nt, Artificial Sequence
  Cas9 variant
auggcaagaauccuagcauucgacaucgguauaaguucaauaggcugggccuuuucagaaaaugacgaacucaaagacugcggcgugagaauauucacaaaagcagaaaacccuaaaacaggggaaucccuagcauuaccaagacgacuagcccgauccgcucgaaaaaggcuagcaagaagaaaagcccgacuaaaucacuuaaaacaucuaauagcaaacgaauuuaaacuaaacuacgaagauuaccaaucauucgacgaaagucuagcaaaagcauacaaaggaagccucauaagcccauaugaacugagauuccgcgcacucaacgaacuucuaucaaagcaagacuucgcuagggugauacugcacauagcuaaacgaagagguuacgaugauaucaaaaacucagacgauaaagaaaaaggcgcaauauuaaaagcuauuaaacaaaacgaagaaaaauuagcaaacuaccaaagcgucggagaauaccucuauaaagaauacuuucagaaauucaaagaaaauucaaaagaauuuacaaauguucgaaauaagaaagaaucauacgaacgcugcauagcacaaucauuccuuaaagacgaacucaaacuaauauuuaaaaaacaaagagaauuugguuucucauuuucuaaaaaauucgaagaagaagucuuaucaguugcauuuuacaaacgcgcauuaaaagauuuuagucaccuaguaggaaauugcaguuucuuuacggacgaaaaaagagccccaaaaaacaguccacuagcauucauguuuguagcauuaacaaggauaauuaaccuucuaaacaacuuaaaaaauacugaagggauacuauacacuaaagacgaccuaaauacacuauuaaaugaaguucuaaaaaauggaacacucacauauaaacaaaccaaaaaacuucuaggccuaucagaugauuacgaauucaaaggagaaaaaggcacauauuuuauagaguucaaaaaauacaaagaauucauaaaagcguuaggcgaacacaauuuaucgcaagacgaccuaaacgaaaucgcaaaagacauaacacuaauaaaagaugaaauaaaauuaaaaaaagcgcuagcaaaauacgaucugaaucaaaaccaaauagacucacucucuaaacuagaauuuaaagaccacuuaaacaucucauuuaaggcacuuaaauuagucacaccacuaaugcuagaaggcaaaaaauaugaugaagcuuguaacgaacucaaccuuaaaguagcuaucaacgaagauaaaaaagauuucuuaccagccuucaaugaaacuuacuauaaagacgaaguaaccaacccaguuguacuacgugcaauuaaagaauacagaaaaguacuaaacgcacuacuaaaaaaauauggcaaaguacacaaaauaaauauagaacucgcacgugaaguagguaaaaaucacucgcaaagagcuaaaauagaaaaagaacaaaacgaaaauuacaaagcaaaaaaagaugcagaauuagaaugcgaaaaacuagguuuaaaaauaaacucgaaaaacauacuaaaacuaagacuauuuaaagaacaaaaagaauuuugcgcauauaguggcgaaaaaauaaaaauaagcgacuuacaagacgaaaaaauguuagaaauagaucauaucuaccccuauucaagaucauuugacgacucauauaugaauaaaguucuaguauuuacaaaacaaaaucaggaaaaacuaaaccaaacaccauuugaagcauucgguaacgacagcgcaaaauggcagaaaauugaaguacucgcaaaaaacuuaccaacaaaaaaacaaaaacgaauacuagacaaaaacuacaaagacaaagaacaaaagaacuucaaagauagaaauuugaaugacaccagauauauagcaagguuaguauuaaacuacacaaaagauuaccuagacuucuuaccacuaucagacgacgaaaauacuaaacucaacgacacacagaagggaucgaaaguacauguagaagcaaaaagugggaugcuaacauccgcacugcgacacacguggggauuuucggcgaaagacaggaauaaccauuuacaccacgccauagacgcgguaauaaucgcuuacgcaaauaacagcauuguaaaagcauucuccgauuucaaaaaagagcaagaaagcaacuccgcugaauuauacgcaaaaaaaauuucagaacuagauuacaaaaacaaaaggaaauuuuucgagccuuucagcggauuuaggcaaaaagucuuagacaaaauugacgagaucuuuguuucuaaaccugaaagaaaaaaaccaagcggagccuuacaugaagaaacauuccgaaaagaagaagaauuuuaccaauccuacggaggaaaagaaggcgucuuaaaggcacuagagcuaggaaagauaaggaaagucaaugggaaaauaguaaaaaacggugauauguuccgaguagauauauucaaacacaaaaaaacaaauaaguucuaugcaguaccuauauacacaauggacuucgcuuuaaaaguccucccuaacaaagcgguagcacgcucaaaaaaaggagaaauuaaagauuggauacuaauggacgaaaacuacgaauuuugcuuuagucuauacaaagauucacuaauucuaauacaaacaaaagauaugcaggaaccagaacuaguauauuucaacgcauucaccucaaguacaguaagccuaaucguauccaaacacgauaauaaauucgaaacccuaagcaagaaucaaaaaauacuauucaaaaaugccaaugaaaaagaaguuauagcuaaaucaauuggcauacaaaaucuaaaaguuuuugaaaaauacauuguaagcgcccugggagaagucacuaaggcagaauuccgacaacgagaagacuucaaaaaugaacuaagauga

SEQ ID NO: 4892 - RNA, 2964 nt, Artificial Sequence
  Cas9 variant
auggcaagaauauuagcauucgacauuggaauaagcaguauugggugggcguuuucggaaaacgaugaauuaaaagauugcggaguaagaaucuuuacgaaagcagaaaauccaaaaacaggagaaagccucgccuuaccucgacgacuagcuagaucagcaagaaaaagacuagcaagacgaaaagcacggcuuaaccaucuaaaacaccuaaucgcaaaugaauuuaaacuaaauuacgaagacuaccaaaguuucgacgagagcuuagcuaaagcauauaagggcagucucauaagucccuacgaacuacgauuccgagcacuaaaugaacuacuauccaaacaagacuuugcgagaguaauacuacauauagcaaagcgucgaggauacgaugauauaaagaacuccgaugacaaagaaaaaggagcaaucuuaaaagcaaucaagcaaaacgaagaaaagcuagcgaacuaccaaucaguaggagaauaccucuacaaagaauauuuucaaaaauucaaagaaaauaguaaagaguucacgaacguacguaacaaaaaggaaucauacgaaagaugcauagcgcaauccuuccuuaaagaugaauuaaaacucauauucaagaaacaaagagaauuuggauucucauuuuccaaaaaguuugaagaagaaguacuuagcguagcauucuacaaaagagcauugaaagauuucucacaucuaguagggaauuguucauucuuuacagacgaaaaacgcgccccgaaaaauucaccacuagcauuuauguuugucgcacuaacaagaauaauaaacuuauuaaacaaccuaaagaacacagaagguauauuauauaccaaagacgacuuaaacgcacuauuaaaugaaguucucaaaaacuccacccuaaccuacaaacaaacaaagaaacuacuagguuuaagcgacgacuacgaguucaaaggcgaaaaaggcacauauuucauagaauuuaagaaauauaaagaauuuaucaaagcacucggcgaccacucccuaagccaagacgaccuaaacgaaaucgcaaaagacauuaccuugauuaaagaugaaaucaaauuaaagaaagcacuugcaaaauacgacuuaaaccaaaaccaaaucgauucucuuucaaaauuggaauuuaaagaucauuuaaauauaucauucaaagcauuaaaacuuauaacaccacuaauguuagaagggaagaaauacgacgaagcauguaacgaauuaaacuuaaaaguagcaauaaacgaagacaagaaagacuucuuaccagcauucaaugaaacguauuauaaagacgaagucacaaacccaguaguauuacgcgcaauaaaagaauacagaaaaguauuaaaugcacuacuaaagaaauacggaaaaguacacaaaauuaacaucgaacuagcuagagaaguagggaaaaacuacagucaaagagcgaaaaucgaaaaagaacaaaaugaaaauuacaaagccaagaaagacgcagaacuagaaugugagaaauuaggauuaaaaauuaacucuaaaaacauucugaaacugcgccuauuuaaagaacaaaaagaguucugugcauacagcggagagaaaauaaaaauaagugaccuacaagaugaaaagauguuagaaauagaccacauauacccauauaguagguccuucgaugauagcuacaugaauaaaguacucguauucacuaaacaaaaccaagaaaaacuaaauaaaacaccauucgaagccuucggcaaugauucagccaaauggcagaaaaucgaaguauuagccaaaaaccuaccaacuaagaaacaaaaacgaauauuagacaaaaauuauaaagacaaagaacaaaaagacuuuaaagacagaaauuuaaacgacaccagauacauagcacgacuuguacuaaauuauaccaaagauuaccuagacuuccuaccucucucagaugaugaaaacaccaaacuuaaugacacucaaaaaggcucaaaaguacacguagaagcaaaauccgguaugcuaaccagugccuuaagacauacuugggguuuuucugcaaaagacaggaacaaucaccuacaccaugcuauagacgcaguaauaauagcauaugcgaacaacagcauugucaaagcauuuucugacuucaagaaagaacaagaaagcaauucagcagaacuauacgccaagaaaaucagugaacuugacuacaaaaacaaaagaaaauuuuucgaacccuucagcggguucagacaaaaaguacuagacaaaauagaugaaauauuuguaagcaaaccggaaagaaagaaaccguccggagcacuacacgaagaaacauuuagaaaagaagaagaguucuaccaaucauacggaggcaaagaaggagucuuaaaagcacuagaauuaggaaaaaucagaaaaguaaauggcaaaaucgucaaaaauggagauauguuccgaguagacaucuuuaaacauaagaaaacuaacaaauucuaugcaguaccaauauacaccauggauuucgccuuaaaaguauuaccaaauaaagcaguagcaagaucaaagaaaggagaaauaaaagauuggauacuaauggaugaaaauuaugaauuuugcuuuucucucuauaaagauagccuaauucugauucaaacaaaagauaugcaagaaccagagcuagucuacuucaaugcauuuacauccucaacaguuucacugauaguaagcaaacaugacaacaaauuugaaacgcuaagcaaaaaccagaaaauacuauuuaaaaacgcaaaugaaaaagaaguaauagcaaaaucaauaggaauacaaaaucucaaaguauucgaaaaauacauaguaagcgcauuaggcgaaguaaccaaagcagaguucagacaaagagaagauuucaaaaacgaacuaagauga

SEQ ID NO: 4893 - RNA, 2964 nt, Artificial Sequence
  Cas9 variant
auggcuagaauauuagcauucgacaucggaauauccucuaucgggugggcauuuucagaaaaugaugaacuuaaagauugcggaguaagaauauucacuaaagcagaaaauccaaaaacaggagaaucacuggcacuaccucgcagacuagccagaagugcacgaaaacgacuagcacguagaaaagcacgccuaaaccaucuaaaacacuugauagcuaacgaguuuaaacuuaauuacgaagacuaucaaagcuuugacgaaucccucgcgaaagcuuacaaaggaucauuaauuucaccauacgaacucagauucagagcacuaaacgaauuacuaaguaaacaagauuuugccagaguaauccuacauauugcaaaacguagagguuacgacgacauaaagaauucagacgacaaagaaaaaggcgcaauauuaaaggcuauaaaacaaaacgaagaaaaauuagcuaauuaccaaucaguaggcgaauaccucuacaaagaguauuuucaaaaauucaaagaaaauuccaaggaguuuaccaaugucagaaauaagaaagagucauacgaaagaugcauagcacaaaguuuucuaaaagacgaacuaaaguuaauauucaaaaaacaaagagaauucggauuuucuuucucaaaaaaauucgaagaagaaguauuaucaguagcauucuauaaacgagcauuaaaagacuucucacaccuaguaggaaacuguucauucuucacagaugaaaagagagcaccaaaaaacucaccacuagcauucauguucguugcccuaacccgaauaauuaacuuauuaaauaaucucaaaaauacagaagggauacuauacacuaaagaugauuuaaacgcgcuacuaaacgaaguucuuaaaaauggaacgcuaacauauaaacaaacaaaaaaacuacucggguuaucagacgacuacgaauuuaaaggagaaaaaggaacauacuuuaucgaguuuaaaaaauacaaagaauuuauaaaagcucuaggagaccacagcuuaagucaagacgaucuaaaugaaauagccaaagacauaacguuaauaaaagacgaaaucaaacuaaaaaaagcgcucgcaaaauacgaccuaaaccaaaaccaaauagacucauuaaguaaauuagaauucaaagaucaccuaaacauuucauuuaaagcacuaaaacuaauaacaccacuuaugcuugaaggaaaaaaguaugaugaagcaugcaacgaacucaaccugaaaguagcaauaaacgaagacaaaaaagacuucuuaccggcuuucaaugaaacguacuacaaagaugaagugacgaacccagucguuuuaagagccauaaaagaauacagaaaaguauuaaaugcuuuauuaaaaaaauaugguaaaguucacaaaauaaauaucgaauuagcgagagagguaggaaaaaauuacagccaaagagccaaaauagaaaaagaacaaaacgaaaacuacaaagcaaaaaaagacgcugaacuugaaugcgaaaaacugggccucaaaauaaacucaaaaaacauccuaaaacucagacuuuucaaagagcagaaagaauuuugcgcuuacucaggugaaaagauaaaaaucagcgauuuacaagacgaaaaaauguuagaaauagaucacaucuaccccuacucacgaucauucgacgauucuuauaugaauaaaguuuuaguuuucaccaaacaaaaccaagaaaaauuaaaccaaacucccuucgaagcguucggaaacgauagugccaaauggcaaaaaauagaaguucuagccaaaaaucuaccuaccaagaaacaaaagagaauauuggacaaaaacuauaaagacaaagagcaaaaagauuuuaaagacagaaaucuaaaugauacaagauacauagcacgacuaguauuaaacuauaccaaagacuacuuagauuuccuaccgcuaagugacgacgaaaauacaaaacuaaacgauacacaaaaagguucaaaaguacauguggaagccaaaucuggaaugcuaacaagcgcuuuaagacauacuuggggauucagugcaaaagauagaaauaaccaccugcaucaugccauagaugcaguaauaauugcauacgcaaauaauucuauuguaaaagccuuuagcgauuucaaaaaagaacaagaaagcaauagugccgaauuguaugcaaaaaaaauuuccgaacuagauuauaaaaauaaaagaaaauuuuuugaaccuuuuagcggauuuaggcaaaaaguauuagacaaaauugaugaaauauuuguaucuaaacccgaaagaaaaaaaccaaguggugcccuacacgaagaaacauucagaaaagaagaagaauucuaucaaagcuacggaggaaaagaaggcguacuaaaagcauuagaacucggcaaaauuagaaaaguaaaugguaaaaucguaaaaaauggagauauguuccgcguagacauauuuaaacacaaaaaaacaaacaaauucuacgccgugccuaucuacacaauggacuucgcccuuaaaguucuaccaaacaaagcagucgcgagaucuaaaaaaggcgaaauaaaagauuggauauuaauggaugaaaauuaugaauuuugcuucucacucuacaaagauucacuuauccuuauucaaacaaaagauaugcaggaaccagaauuuguauacuacaaugcauuuacaagcucuaccgucucauuaaucguaaguaaacaugauaacaaauucgaaaccuugagcaaaaaccaaaagauacuauucaaaaacgcaaaugaaaaagaaguaauagcaaagucuauaggaauccagaacuuaaaagucuuugaaaaguauaucgugucagcauuaggugaaguaacuaaagcagaauucaggcaacgggaagacuucaaaaacgaacuacgauga

SEQ ID NO: 4894 - RNA, 2979 nt, Artificial Sequence
  Cas9 variant
augagaauauuuagcgaugggagaaauccaaaagauggaucaagccuugccguaacuagaagggcagcuagagcaaugagaagaagaagagaccgucuuuuaaaaagaaaaacaagaaugcaagcaaagcuaguagaacauggauucuuuccugcugaugcaggaaaaaggaaagccuuagagcaacucaauccauaugcauuaagggcaaaaggauuacaagaagcauuguuaccaggugaauuugcacgggccuuauuucauauaaaucaaagaagaggauuuaaaucaaauagaaaaacagauaagaaagauaaugacucuggaguguuaaagaaagcuauuggucaauuaagacaacaaauggcagaacaaggaagucguacuguaggagaauaucuauggacuagacuacaacaaggucaaggcguaagagcacgguacagagaaaaaccauauacgacugaagaaggaaagaaacgaauagacaaaucauaugacuuauauauagauagagcaaugauagaacaagaauuugaugcacuaugggccgcgcaggcagcauucaacccuacauuguuucaugaggcagcaagagcagacuuaaaagacacauuacuacaucaaaggccacuuagaccaguaaaaccaggaagauguacacuccuaccagaagaagaaagagcaccacuagcgcuuccgaguacacaaagauuccgaauacaccaagaagucaaucacuuacgacuucuagaugaaaaucuaagagaaguggcacuaacucuagcgcaacgagacgcgguuguuacagcucuugagacuaaagcuaaauuaucauucgaacaaauucgaaaauuguuaaaauuaaguggaaguguacaguucaaucuugaagacgcgaaaaggacagaacuaaaagguaaugcaacuagcgcagcuuuagccagaaaagaauuauucggcgcugcuuggaguggauuugaugaagcucuacaagacgaaauaguauggcaguuagugacugaggaaggagaaggagcgcuuauagcguggcugcagacucacacgggugucgacgaagcaagagcacaagcaauaguggacgugucauuaccagaaggauaugggaauuuauccagaaaggcuuuagcaaggauaguacccgcauuacgagcugcuguaauaacguaugauaaagcuguacaggcugcagguuuugaucaccauagccaacuaggauuugaauaugacgccucagaaguggaagauuuaguacauccagaaacaggagaaauccgaaguguauuuaaacaacuaccauauuauggaaaagcacuacaaaggcaugucgcauucgguucaggcaagccagaggauccggaugagaaaagauaugggaaaauagcuaacccaacaguacacauaggucugaaccaagucagaaugguaguaaaugcguuaauaagaagauaugguagaccgacggaagugguaaucgaauuagcaagagaccuuaaacaaagucgggaacaaaaagucgaagcccaaagaagacaagcagauaaucaaagacggaaugcaagaauuagaagaaguauagcagaaguauuagguauaggagaagaaagaguaagaggaagugauauacaaaaguggauaugcugggaggaacucuccuucgacgcagcagauagaagaugcccauauaguggaguacaaauaagcgcggcuaugcuacucucugacgagguugaaguagaacauauauuaccuuucucaaaaacgcuagacgauagccucaacaauagaacaguagcuaugaggcaagcgaauagaaucaaaagaaauagaacaccaugggaugcaagggcagaauuugaagcacaaggaugguccuacgaagauauauuacaaagagcagagagaaugccauuacgaaaacgauaucgcuuugccccugaugguuaugaaaggugguuaggagacgacaaagauuuccuugcacgagcuuuaaaugauaccagguauuuaaguagaguagcagcggaauaccugcgacuuguaugcccgggaacaagagucauaccaggacaauuaacugcacuauugagaggaaaauuuggcuugaaugaugucuuaggcuuagauggugagaaaaauagaaaugaccaucgacaucacgcaguagacgcguguguaauaggaguuaccgaucaaggauuaaugcaacgcuucgcaacagcgucagcacaagcuaggggagacggcuuaacgcgacugguggacgguaugcccaugccguggccaacauacagagaucacguugaaagagcaguacgucacauauggguuagucauagaccagaucaugguuuugaaggugcuaugauggaagaaacuucguaugguauaagaaaagacgggagcauaaaacaaagaagaaaagcagacggaucagcugguagagaaauaaguaaucuaauuagaauacacgaagccacacaaccguuacgucacggaguuagcgcggacggacaaccccuugcauauaaaggauacguaggaggaagcaauuacugcauugaaauaacagugaaugacaagggcaaaugggagggcgaaguuauuucaacauuuagagccuacgguguaguacgugcaggagggaugggaagauuacgaaauccucaugaaggucaaaacgguagaaaacuuauaaugagauuagucauaggggauaguguccgauuggaaguagauggugcagaaagaaccaugagaauaguaaaaauaucagguaguaacgggcaaauauucauggcacccauacacgaagcuaacguagacgcccgaaauacggacaagcaagaugcauucacauacaccaguaaguacgcaggaaguuuacaaaaagcgaagacaagaaggguuaccauaucaccaauaggcgaagugagagauccagguuuuaaaggauga

SEQ ID NO: 4895 - RNA, 2985 nt, Artificial Sequence
  Cas9 variant
augacucucggauuagacuuaggaacgaacagcauaggaugggcauugauagauuuugacgauaaccaacaaccgagaaaucugauagcuugcggaucaagaauauuucaagaagcuguagaagcaaaaacagguacccccaaaaaucaugcaagaagaacagccagagcagcucgcaaauuaguugcucggagaaaacaaagacgaacaaaacuauuaaaccugcuaauaaggcauggcuuauuaccucaagacguugcagaaagaaaugcacuauuauuagacaaccaggcuaacaaccccuaccaauuacggaaacgaggauuagaugaaaaacuugaaccuuuugcuuuugguagagccuuauaucaucucgcucaucgaagaggguuucaauccaaucgaaaggcagcuagugaugaagaugggaaagucaaaacggcgauuucaacuuuaagagccgaaaugcaaggaagaacauuaggagccuuuuuggcagaccaaccaacgcaaaggcgacgauauacugacagggcaauguacguagaagaauuugaacaacuauggaguaagcaggcaaguuuuacccaagaacaauuaacacaggcacucaaaguagcaauacauaauucuaucuucuuccaaagaccauuaaaaucacaaaaacaccuaguagguaagugcacauuugaaccgacuagaaaaagagccgcaaaagcaauacuuuuaacccaaagauuuagaauuuuacaagacguaaaucauuuagcaguaaagaacccaauuaccagagaauuuagaccauuaacucaagaugaacggaacaaauuagccgaagcacuugacaaacagaaauccaugacauggggagcgguucgaaaaguaauagguuggaauaagaaagauucguuacaugaaggugaaacauuuaauuuggaagaggguaagaaagacaaauuaauaggaaauagaacggcaugugaccucagaggagcucucggagauagaugggacgcuuuaacugcacaacaacaggacgaucuaguaacagacuuguugacaauagacaacacggauggauuuuuaaaaagaaugaaaacacacugggaauuugacgacgcaacagccgaaguaauugcaaaaauagaauuagaaccuggcuaugcgagauuaucagcaaaagcaaugagggcaauacugccauaucuagaacaaggaaugauuuacucagacgcaugcaaagcugccggauaugaccacucaaauccaaaucaaagaacgaucacagacaaauuaggacuaccaucaaauguaagaaaccccguaguacagaaagcacuuuuugaaacuagaaaaguaguaaaugccauaguuagaaaauauggcaaaccagcaguaauaagaguugaaauggcaagagauaugaaacugucaaagcgccagaaagaagaacuccaaaaagaacaaaauaaacaaaagaaagcuaaugaauuagcagaaggaauuuuaagaaaagaguucggaauacagcaaccagcuagagcagacauucaaaaauacaacuugugguuagaauguaaagaaguuugcccuuauacagguacaaccauuucaagagaaaugcuauuuucaccagaaguugaugucgaacauauacuaccauauagucgaucccuugaugauucuuauaugaauaaaacacuaugcauggccaccuucaacaggcagguuaaacuaaauaacacaccuuacgagauugggcaaggagauccauuagcuuaugcagaaauauuucaaagaauaaaaacauugccauuuccaaaacgaagaagauuugaacaaaaagaaauagaaacagauaaauucauagaacgacaacuaaaugauacuagguauauaugcguagaaguacgagacuuucuacaacaauugggagcaccaguagaagucucaaagggagaagcuacugcgaaauuaagaggaagauggaaauuaaacacacuauuaagcccagauggaucaaacgaaaaauauagaggagaucacagacaucaugcaauagaugcaguuguuauugcacucacuaaucggagucucuuucauaaauugaguagauuaucagcacaaucaauaaguuuagacaaaagcagauuugacguacccccacccugggacggauuuuaugacgacguauacgagaaaaucgacaaaguaauaguaucacacgcaccagcuagaaaaauagguggagcucuccaugaagacacugcguauggucauuuuaaagaagaaguagcugaucccaaaacaggaaaaguaaguauagaggacagauucguauauagaaaaccauuagccacgcucacagcaaacgaaguugguaaaauaagagacgcaaaaguccgagaauuugucgaagcucgacucgcccaauucggaaauaacucaaaaacagccuucggagauccaaauaacccauuacuacacgcagacgguaaaacgccaauacgaacaguuagauuaguaacaaauuuuaacaaagccaccacacaugcaauacaaaaaggccaagguagagacuacaaauuuuucaaauacgguaacaaucaucauguagagauuauagaacacguugaaaccggaaaacgaaaaggaaucuucguaacagcaauggaagcagcaagaagaguacgcggaguagcuaauacagaaaagucagauaucguccaaagaaaucacggagaggaauggagauucguaaugucuuuaucaauaaaugaccuuguaaguauucaggaagcugaucaagucagaauaaugagaguacaauuguuugaugccucaaaugggaauauaauauuuagagaucaaaaaucagcaaugcuagaugacaagcuaucacgcuaucaaacgaaagcccaucugcuaguaugucagaaaauuaccaccgauccacuaggaaaucuagcaccuuguaaugauuga

SEQ ID NO: 4896 - RNA, 2988 nt, Artificial Sequence
  Cas9 variant
augucaaaaguucuaggacuagauauaggagcaaacagcauaggaugggcccuuaucgaugacgaagaaaacgauauaauaggugcagggguacggguauucaaagaaggagucaauuuaaagggaguaaaagaagaaaguaaaaauguagaaagaagagcagcaagguuagcccgaagacaacauaaaagacgaagccaaagacggaauagacuagucgcacuacuaaaaacccuugaaauguuuccagagaauaacgaagauauuucagauuacuacgcacaagacccauaugaacuaagaaaaaaaggcuuauacgaaaaacuaacaauguaugaauucgguagaguauuauuacacauaugcagaagaagagguuuuaaaagcagccgaaaaacagauauaucagaagaagguaaaaucuuugaaggaaaagacggaauaguaggaauaaaucaaacaagagacagcauaagggaggguggcuucaaaaccaucggugaauacuuagcaucacuugauccacauguuauaagaaggagaaacagauucacacuacgagauauguacgaagaagaauucaaccuaaugugggagaaacaacaaucauuuuauccccuccaauuaucuaacgaauucaaagaagccauagcagaaguuauucuaagucaaagaaaacuaaaaucacagaaagcgcuggugggcaauugcggauuagaaccuaauaaaaaaacagcaccgaaaaguucuccugcauuucaguacuuucggauauuagagcaacuaagcagaauucuuauaucgauaccacacacggguagguacaaugacccuuuaaacgaagaagaaaggagaauguuaaucgacaaacugucagucacagaaaaacucaaauucagugacaugagaaaaaugcuaaaccuaccgggagaaucugacauuaauauagaggaagaagguggaagacuacuuggcaacaccacauacgcaaggcuaauaaaaguuuucggaaaaaaaagaugggcagguuuuucagaagaagaaaaagaacaaauuuggcacacauuccauuucgcagauaaccaugaauggcuaaaagaauaugcauuaaaaaaguggucaauaacaccagacgagauuaaagaacuuggaaaaguggcauuagaaaaagaauaugcgcgauuuucuaaaaaaucacugaaaaaaauaauaccccaacuagaagaagggcuaacgcuagauaaagcuaaaauagaagcagguuacacuccagaauaugaaauagagaaaagccuaagugcguacuuaccauuaccagaaaauauccgaaacccaaucguacaacaagcacucuacgaauuaagacacguagugaaugcggucauaagaacauacgguaaaccagauauagcuagaguagaacuggcaagagaaaugaaaaaacccaaacaaaaacgugaaaaaaugagaucagaguuaagaaaacgccaaaugaaauuugaagaaauaaaaucaauucuaaaagaaagauuaggauuuauagacccaaaaagagacgaaauucauaaauauauguuaugggaggaaugucgcgaaacauguccauauacuggcagaaaaauaucucucucggcccuauacgguggagauuuugaaguagaacauauaauacccuauaaaagaucccuagaugauucauuauuuaacaaaacugugugcuuaagagaagaaaaccaaauaaagggagauagaacaccauacgaggcauacaguggggaccgucagaaauaugaagaaauuauuuuaagaguccaaaaaacgucaaugccucgaggaaaaaaaaaccuuuuugcaaucaaagaauuaaaagaugacuucgcacacagacagcuauccgacacagcauauaucucacgcgaaacacgaaaauaccuuggcagcacaauaaaaaaagugcaagcgguuaaagguggcagcacagcaaaauuacgauacuacuggggucuaaauaguauacugggaguacgagacauaaaaaugagagacgaccauagacaucaugcaguggacgcucuugucauagcaaauacaacuuaugcuuuuguuaauacgcucagccgauaucacucgauggauguagaaccucaugaaucuagauuuccauugccaugggaacaauuuagaaaugaugcugaaagcguaguaagaaauauauucgugagccaccgucuuggaaaaaaagcaacgggacaauuacaugaagaaacauauuacgguaaaauaagaaacaccgauggagagccauauuucgucguuaggaaaaaacuagguacguuaacagccaaacaaauagcaaauauuguugauccgguaguaaagacacaaguguucgaaagacuagaagaaaaaggaaucgacaucgaaucuucaaacaaaauaccagcagaugcuuuuguagaaaccuuauacaugccagauaggaaaacaccuauuaaaucaguaagaguuaaaguaccaucaacaacuaugauacaacucuacaaggacaaagaacuauauguggacccagguucaaaucaccacaucguaauauucgaaaaugaggaaggaaaacgagauggcauaguagugucacuauuugaagcagcacaaagacuaagaagaaacgaaccugucauacaaaaaacauggaaaccagaauggcauuucguaaugagucuaucaauagaugaacuuauauuacucgacguagaugagaagaauaucgauuggggcgauacaggauuagcuuugcgauacucgaaagcauuauauagaguucaaaaaauggacguaaauaaaauaauaacucugagacaccaucucgucgcuagguuaaaagaugacgaaggaaaagaauucggaagagaacacagaauaccuagcacacugaggggucuaaaagucaaaauugaucauauuggaagacuaagaagggcguaugacuga

SEQ ID NO: 4897 - RNA, 2988 nt, Artificial Sequence
  Cas9 variant
augaaaguaauaggauucgacauuggaauaaauuccaucggaugggcauucguagaaaacgacgaacuuaaagacugcggugugagaauauucaccaaagcagaaaaucccaaaaacaaagaaucacuagcguuaccgagaagaaacgccagguccaguaggaaaagacuaaaacgaagaaaacuccgccuaauugcaaugaaacacauccucgccaaagaacuuaauuuaaacuacaaagacuacauagcaaaugauggcgaacuccccaaagccuacgaaggaaaacucaucagucccuacgaacucagguauaaagcacucaaucaaaaacuggaagcgaaagacuuagucagaguaauacuacacauagcaaaacaccguggauacaugaacaaaaaugauaaaaaaaguaaugacgccgaaaaagguaaaauauugucggcacuaaaaaauaacgcacuaaaacuagaaaaauaccagucaguaggagaauauuucuacaaagaauucuuccaaaaauacaaagaaaauacuaaagacuucauaaaaauaagaaacauaaaagacaacuacaauaacugcguauuagccagugaccuagaaaaagaauuaaaacuaauacucgaaaaacaaaaagaauucggauacagcuacucaaaugacuuuauagaagaaguaauacaaguagcauuuuuccaacgaccucuaaaagauuucagccacuuaguaggaaccugcacauuuuuugaagaagaaaaacgagcaugcaaaaacagcuacucagcaugggaauuuguagcucucacaaaaauuguaaaugaacucaaaucauuagaaaaaauaucaggagaacuuauaucaacucaaacaauaaacgaaauacuaaacuacauacucgacaaaggaagcauaacauauaaaaaauuuagaucauauauaaaccucuaugaaaguauaaaauuuaaaagcuuaaaauacgacaaagauaaugcagaaagugcaaaauugauagauuucagaaaacuaguugaauuuaaaaaagcucuaggugaacacuacuuuaacagacaagaacuugaucaaauuucaacuuacauaacacuaauaaaagacaauguaaaacuaaaaacagcauuagaaaaauacaaucuaucaaaugaacaaauaaacaacuuacuggaaauagaauucaacgaucacauaaaucuuuccuucaaagcauuaucgaugauuuuaccccuuaugaaagaaggaaaaaaauaugaugaagcaugugaaauagccaauuuaaaaccgaaaaccacaaaccaaaaacaagauuuuuugccagcauucuguaacucaauauucguccacgaacuaucaaauccaaucguaaacagagcuaucagcgaauacagaaaaguacuaaacgcacuacuuaaaaaauacggaaaaguacacaaaauacaccucgaacucgcaagagauaucgggcuauccaaaaaagccagagaaaaaauagagaaagaacaaaaagaaaaccaagcaauaaauacaugggcccuaaaugaaugcgaaaacaugggaauaaaagcaaacgcuaaaaacauacuaaaacuaaaacuauggaaagaacaaaaagaaauaugcauauauagcggcaagaaaauaucaauagaacaucuaaaagacgagaaagcacuugaaguagaccauauauaccccuacucgagaaguuucgacgacucauacaugaacaaaguauuaguauucaccaaggaaaaccaagaaaaauugaauaaaacaccuuucgaagcauucggaaaaaauaucgaaaaauggaacaagauacaaacacuagcccaaauauuaccauauaaaaagaaaaacaaaauacuagaugaaaacuucaaggauaaucagcaacaagacuuuauaaguaggaaccuaaaugauacuagauacauagcaacccucauagcuaaauacacaaaagaauaccuuaacuuucuaccauuaaaugaaaaugaaaacauaaaucucaaaaguggagaaaagggaucaaaaauacacauacaaacagucaaugggaugcuaacaucggugcuccgccauacuuggggcuuugacaaaaaagauagaaacaaucaccuucaccaugcccuagacgcgaucauaguagcauacucuacuaauucauuaaucaaggcauucagugacuuuaaaaaaaaucaagaguuacuuaaagccaaacuauacgcaaaagaacuuacaaacgacaauuacauccaucaagcaaaauucuucgaacccuuugaaggcuuuagagaaaagauacuaaacaaaauagaugagauauuuguaucaaagccgccacgaaaaagagcacgaggagcccuacacaaagagacauuuuacucagagaaaaaaaugauaaaaaaauauaacuccaaagaaggacuaaacauagcacuagacugcggaaaaauaagaaaaauaggaacaaaauacguagaaaaugauacaauggugagaguagacauauucaaaaaacaaaacaaauucuacgccauccccauauacaccauggacuuugcacuagggauacuccccaacaaaauugucguaauuggcaaagacaaaaauaacaauccaaaacaauggcaagaaaucgaugaaucauacgaauucuguuuuucacuauauaaaaaugaucuuauccuauuacaaaaaaaagauaugcaagaagcagaauucgccuacuauaacggauucgacauugacucuagucgaauaaacauaaagaaacacgacaauaaauucgaaaaccucacaaguaaucaaaaacuacuauucacaaacaaagagaaaaacaggacaggaauucaaaaucuuaaaauauucgaaaaauauaucguuacacccuuaggaaacaaaaucaaagcugacuuucaaccaagacaaaacauaaguuuaaaauccagcaaaaaaaauggcuuauga

SEQ ID NO: 4898 - RNA, 2988 nt, Artificial Sequence
  Cas9 variant
augaaaauccugggauuugacaucggaauuaacucaauaggcugggccuucguagaaaacgacgaauuaaaagauuguggcguacgaauauucacaaaagcagaaaacccaaaaaauaaagaaucacucgcacucccacgaagaaaugcacgaucaaaccgucgaagacucaaaagaagaaaaagcagacugauagcaauuaaacauauacuugcaaaagaacuuaaucuaaauuauaaagacuauauagcaaaugacggagaacuaccaaaagccuacgaagguaaauuaaccaauguuuacgaacuaagauauaaagcacucaaccaaaaacucgaggcuaaagauuuagcaagagucauucuacacauagcaaaacauagaggauacaugaacaaaaaugaaaaaaaaucgaaugacagcgaaaaaggcaaaauacucagcgcucuaaaaaacaacgcacucaaacuagaaaaauaucaaucuguaggagaauacuuuuauaaagaauuuuuccaaaaauacaaagaaaacacaaaaaacuucauaaaaauacguaacacaaaagacaacuauaacaauugcguacucgcuucagaucuugaaaaagaauuaaaacuaauacuagagaaacaaaaagaguucggauauucauacaacgaugacuucaucaaagaaaucauaaacauagcuuuuuuccaaagaccacuaaaagacuuuucacaccuaguuggaagcugcacauuuuucgaagaagaaaaacgagcuuguaaaaacucauacucugccugggaauuuguagccuuaaguaaaauaaucaacgaauuaaaacgauuagaaaaaauaucaggagaacuuauaucugcacaaacuauaaaugaaauacuuaaccacauauuagacaaaggaaacauaacguacaaaaaauuuagaucaugcauaaaucuccaugagagcauagaauucaaaucacuaaauuaugauaaagacaacgcagaaucagcaaaacucguagacuucaaaaaacuaaucgaauucaaaaaagcacuaggcgaacacucauuuaaccgacaagaacuugaugaaaucgcaacccauaucacccucauuaaagacaacgauaaacucaaaacagccuuagaaaaauauaaucuaaauaacgagcaaauaaacgcacuccuagaaauagaauucaacgaccauauuaaucucucuuucaaagcccuuaacuuaauauuaccccucaugagagaagguaaaagauacgacgaagccugcgaaauagucaaucuaaaaagcaaaacaaguaaccagaaacaagauuuacucccugccuucugugacuccauuuuuagucaagaacuguccaauccugugguaaauagagccauuucagaauacagaaaaguauugaaugcccuacucaaaaaauacggaaaaguccacaaaauacaccuagagcucgcacgagauguaggacucuccaaaaaagcacgugaaaaaauugaaaaagaacaaaaagaaaacaaggagauaaacgacugggcauuagacgaaugcgaaaaauuuggcuuaaaagcuaauaacaagaauauacucaaacuuaaacuauggaaagaacaaaaagaaauuugcgcauacaguggcaagaaaauaucaaucgaacaccuaaaagaugagaaagccuuagaaguggaucacauauacccauacucaaggagcuucgacgacuccuacaugaacaaaguucuaguuuuuaccaaagaaaaccaagaaaagcuaaacaagacacccuucgaagcauuuggcaaaaauaucgaaagauggaacaaaauccaagcacuagcccaaaaccugcccuacaaaaaaaaaaauaaaauacuugaugaaaacuucaaagauaaacaacaacaagacuuuauuucacgaaaucugaaugacacacgauauaucgcuaccuuaauugcaaaauacacuaaagaauaccuuaacuuucuaccgcucaaugaaaacgaaaauacaaaccucaaaucaggagaaaaaggauccaaaauacauguacaaaccauaaacggaaugcucaccuccguuuuaagacauacuugggguuuugauaaaaaagaucgaaacaaucacuuacaucacgcacuugacgcaauaaucguagccuauaguacaaauucaauaauaaaagccuuuucugauuuuaaaaaaaaccaagaacuacuuaaagcuaaacuuuacgcaaaagaacuaacgucagacaauuacaaacaccaagcaaaauucuucgaaccuuuugaaggauuucgagaaaaaauacuaaacaaaauagacgaaauauucguaagcaaaccgccgagaaagagagcacgaggaacauuacauaaagaaacauuuuacccagaagaaaccaugauaaagaaauacaacuccaaagagggacuaaacauagcacucaacugcggaaagauacgcaaaauaggcacaaaguacguagaaaaugacacaaugguaagauuagacauauucaaaaagcaaaacaaauucuaugcuauaccaauauacacaauggauuucgcacucggaauacuccccaauaaaauugucaucgcaggcaaggacaaaaacaauaacccaaaacaauggcaagaaauagaugagaguuaugaguuuugcuuuagccucuauaaaaacgaucuaauacuuuuacaaaaaaaagacaugcaagaagccgaauucgcauauuauaauucauucgacauagacucgagucgaaucaacaucaaaaagcaugacaacaaauucgaaaaccuuacagacaaccaaaaauuacuauuuacaaaucaagaaaaaaacagaacuggaauacaaaaccugaaaauuuucgaaaaauacauuguaacaccuuuaggagacaaaauaaaggcagacuuucagccacgccaaaacauaagucuaaaaacaaguaagaaauaugguuuauga

SEQ ID NO: 4899 - RNA, 2991 nt, Artificial Sequence
  Cas9 variant
augauggguaacuucacacucggauuagaucuaggaacuaacucaauaggaugggcccuaauagauuuugaugacaaccaacaaccucaaaauuuaauagcuugcgggagucgcauauuucaagaagcaguagaagccaaaacuggcacacccaaaaaucacgcaagacgagcagcccgagccgccagaaaguuaguugcacgacgaaaacaaaggaggacaaaauuacuaaauuuauuaguaugucacgaccuccuuccacaagaugaagcagaaagaaacgcacucuuacuagauaaucaagcaaacaauccauaccagcuaaggaaaaggggucuagaugaaaaacuagaaccauuugcauuugggcgggccuuauaccauuuagcccacaggagaggauuucaaaguaauagaaaagccgcaucagaugaagauggaaaaguaaaaacagcaauuucagcacuucgagcagaaaugcaaggccacacuuuaggagccuuucuagcugaucaacccacacaaagaagaagauauaccgacagagcaauguaugcggaagaauuugaacaacuauggucaaaacaaacaauauuugcacccgaacaacuaacucaagcacuaaagguagaaauuaaaaauaguauauucuuccagcgaccauugaaaagucaaaaacaucuaguaggcaaauguaccuuugaaccaacacgaaaaagagcagcaaaagcaauauuacucgcgcaacacuuucguauacugcaggacguaaaucauuuagcaguuaaaaauccaauaacaagagaauuucgaccucugacacaagacgaacgaaacaaauuagcagaagcauuagauaaacaaaagggaaugaauuggucugcaguaagaaaaguaauaggauggaauaagaaagauucgcuacacgaaggagaaacuuuuaaccucgaagaggggaagaaagauaaauuaauaggcaacagaacagcaugcgaccuacguggagcguuaggagacagaugggacgcuuucacggcaccacaacaagacgacuuaguuacagauuuacuaaccauagauaacccugacggauuccuuaaaagaaugaaaacacauuggggcuuugacgacgcuacugcagaagcauuagcuacgacagaauuagagccuggauaugcuaggcuaagcucaaaagcgaugagggcaauuuuaccgcaucuagagcaaggaaugauauacucagacgcauguaaagccgcagguuaugaucacucaaauccaaaucaaagaacaauaacagacaaauugggcuuaccaucgaauguccggaauccaguaguacaaaaagcacuuuuugagacaagaaaaguaguaaaugccauaguaagaaaauacggaaaaccugcgguuauacgugucgaaauggccagagacaugaaauuaucaaaacgacaaaaagaagaauuacaaaaagaacaaaauaaacaaaagaaagcaaacgaacuagcagaaggaaucuuaagaaaagaauuugguauacaacaaccagcaaggacugauauacaaaaauacaaucuaugguuagaauguaaggagguuugcccauauacaggcacaguuauaagcagagaaauguuauauaguccagaaguagauguagaacacauauuaccguauucaagaagucuagacgauucauacaugaacaaaacacuauguauggccacauauaaucgacaaacaaaauuaaauaauacaccuuacgaaauaggucaaggagacccagucgcuuaugcagaaauauuucagagaaucaagacacuaccauucccaaaaagaagacgcuuugaacaaaaagaaauagagaccgacaaauuuauagaaagacaauuaaacgauacacgauacauaugcguagaaguaagagacuuucuacaacaacuaggugccccaguagaaguaucaaaaggugaagcgacagcaaaauuaagaggaagauggaaauugaauacuuuauuaucacccggcggugguaacgaaaagaauagagcagaucauagacaucacgcuauagacgcaguuguuauagcucuaacaaaucgauccuuauuccauaaauuaucacgacucucagcgcagaguauaucauuugauaaaagccguuucgacguacccccacccugggacgacuuuuaugacgauguauacgaaaagauugauaaagucaucgucucacacgcaccuaccagaaaaauaaguggagcauuacacgaagcuacagcauauggacauuuuaaagaagaaauagcagacccgaaaacagguaaauucucuauugaagacagauucguuuacagaaaaccucucacuacuuugacagcaaaugaaguagguaaaaucagagaugcuaaaguaagggagcuaguagaagcccgauuagcacaauucggaaacaacucaaaagcugcauuuggagauccgaacgagccacugcuucaugccgacggaaaaaccccaauaaggaccauaagacuaacaacaaacuucaacaaaacuacaacacacgcaauccaaaaaggacaagauagagauuauaaauucuucaaguauggaaauaaucaucacguagaaauaauagaacauguugaaacuggaaagagaaagggaauauucgucaccgcaauggaagcagcaaggagagcaagagguguggcaaauacugaaaaaucuaauauaguccaacgaaaucacggcgacggauggaaauuuguuauguccuuagccgucaaugacaugguacguacagaagauacgcaagcaauauauaggguucaaaaacuagauggaaguaauaacagauuuacucuaaggagccauaacgcagccacacuugaugauaaacaaacaggcguagacaagacuccaaaccucuucaaagguaccaaaauaauaguagacccauuaggcaaucuuacacaguguaaugauuga

SEQ ID NO: 4900 - RNA, 2994 nt, Artificial Sequence
  Cas9 variant
augaaaguucuaguagaugcaggauuaaugcccagugauccagcagcugcaaaagcauuagaaacacuagaccccuacgaauuacgagcuacuggucuagauguaaugcuaccacuaacacacuuagggagagccguuuuucaccuaaaucaaagaagaggauuuaaaaguaauagaaaaacggauagaggagauaaugaaucaggaaaaauaaaagaugcgacaaaaagguuaacuugggcaaugcaagaagcuggggccagaacauauggagaauuucuucacaugagaagggcacgggcaagugauccaaggcagguaccaagcguuagaacaagauuaaguguugcgagcaggggaggacccgauaguaaagaggaagcaggguaugauuuuuaucccgagcgcgcgcacuuagaagacgaauuucacgcacuauggagugcccaagcugccuuccacccugaucuaacgugugaauuacgcgauguaguguuugagaaaauauuuuaucaaagaccauuaaaagaaccaaagguaggcuuaugcuuauuuacagcugaagaaagguuaccuaaagcccauccguugacugguagaagaguauuauacgagacaguaaaccaauuaagaguuacugcagacggaaggacaacaagaccccuaacauuagaagaaagagacaugauuguauacgcacuugacaauaaaaagccuguaaagucauugagcagcaugcaucuaaaauuaguugcucuugguaagcuagugaaacuaaaagacggugaacgauuuacauuagagucagggguaagagaugcgauagcaugugauccuauacgagcaacaaugggucauccagauggauucggaccagcuuggaguaggcuggacuggcaagcucaaugggcacuaauagaaaaauuacgucaaguucaaagugaugaugauuuugcuucuuuaguagccugguuaggcgcaacacauaacuugucagaagaucaugcaaaaagaguagcaaauuuacaccuacccgaagguuauggaagguugggcuugaccgcaaccgaagcaauucuauguaaucuaaaagcugagguauguacguauucacaagcaguggaaagauggggcaaacaccauucaaaccaaaggacaggagaguguuuagaagcucugccauauuauggagagguauuagauagacaugucauaccuggaacauauaacgaagacgacgaugacguuacacgauauggaagaauaacgaauccaacaguucauaucggucuuaaccaacuaagacgauuaguuaauagaauaauugcaacuuauggcaaaccagaucaaauagucgucgaacucgcaagagaauuaaaacaaucagaagcccagaaaagcgaggcccuaaagaaaauaagagauacaaccgcagaugcgauaagaagaggacgacaacuagaagagauaggucagaaaaauacaggugccaacagacuauuguuaagguuaugggaagauuuagggcccgcuguagguccuagaugcugccccuauacaggaaaaccaauaucaguuacgauguuauuugauggagcaugugauguugaucacauuuuaccauauucacgcacacuagacgacuccuucgcuaaccguacaauauguuuaagagaagcuaacagacaaaaaggcgauagaaccccaugggaggcgugggguggaucggaucaaugggaugcaauugaagcaaacuuaaaagaucuaccggaaaauaaacgaaaaagauucgcaccugaugcuauggaaagauuugaaggagaaagagacuuuuuagauagagcucuaguggauacgcaauaccucgcaagaauaagcagggcguaucucgacacacuuuucacagaaggcggucauguauggguaguuccuggaagaaugacagaaaugcuucgccgacauuggggucugaacgcauuacuaagcgauaaagauagaggagccggaaaaguuaaaaacagaacagaucaucgacaccaugcaauagaugcagcaguaauugcagcgacagaucacaguuuaguaaacagaaucucaaaagcagcaggacaaggugagucagcagggcaauccgcagaauuaauagcacgugacacacccgaaccuugggaaggauuuagaaaugacauaagugcacaaauugcgcguauugugguaucacaucgagcagaucauggaagaauagauguagaaggaagaaagcauggaaaagauaguaccgcaggaagacuacacaacgauacagccuauggaauaguagaugaucauacgguaguaaguagaacgccacucuuaucacuuaaacccggagauauagaaguaaccaccaaagguaaaaacauuagagauacacaacuacaaaaagcguuaaguguagcuacaacaggaaaagauggaaaaggauuugaagaagcguuaagaaacuuugcagaaaaagaaggaccuuaucaaggcauaagaagaguaagauuaauagaaacauuacaaaguagugcgagaguagagguaggaucagaugaagauggacaaccuuuaaaagcauacaagggugauaguaaccacuguuacgaucuguggaagcuaccugaugguaaagugguaccccauguagucagcacuuaugaagcgcacgccggcacagacaaaagaccucauccagcagcaaaaagaauauuaagaguauuuaagaaagauaugguggcuauugaacaagaugaucaaacagcaaucuuuuauguacaaaaauuagauagagcaaauggucucuuucuggcaccacauuuagaagcaaaugcugaugcacgacauagaaaucccaaugaugccuuuaaauuucuccaaaugggagcggggagcgucguaagaaauaaacugaggcgaguauacguagaugaaauagggagaauaaaagauccagguccaccaaaacauuga

SEQ ID NO: 4901 - RNA, 2994 nt, Artificial Sequence
  Cas9 variant
augaaaauauuaggauucgacauaggaauuaauaguauuggaugggcauuuguugaaaacgaugagcuaaaagauugcggggucagaaucuuuacagaagcugagaauccaucaaauaaagaaagcuuggcacuuccaagaaggaacgcaagaucaaguagaagacguuuaaaaagacgaaaagccagauuaguugcaaucaagcgaauucuugccaaagaacuaaaacuaaauuuuaaagauuaugucgcagcagacggagagcugccaaaagcauacgaagguaaacuuacuucuaucuacgaacuacgcuacaaagcauuaauacaacaguuagaaacaaaagaucuagccagagugauccuccauaucgcgaagcacagaggcuauaugaacaagaaugaaaaaaagaguaacgacaccaaaaaagguaaaauacucagcgcauuaaaaaacaacgcucuaaagcucgaaaauuaccaaagcgugggugaguauuucuauaaagaauucuuucaaaaauauaaagaaaacacaaaaaauuucauuaaaauaaggaauacaaaagacaacuacaacaacuguguacugucauccgaucuagaaaaagaauuaaaacuaauauuagaaaaacaaaaagaauuuggauacaauuauuccgaagacuucauuaacgaaauauuaaagguggcauucuuccaaagaccacuaaaagacuucagucacuuagugggagcaugcacauucuucgaggaagaaaaaagagcaugcaaaaauucauacagcgcgugggaauucguagcauuaacaaaaaucauaaacgaaaucaaaucauuagaaaaaauaucaggagaaauaguaccaacacaaaccauaaaugaaauacucaacuuaauauuagacaaagguagcauaaccuacaaaaaauucagaucauguauaaaccuacaugaaucaauauccuuuaaaucccuuaaauaugauaaagaaaacgcagaaaacgcaaaacuaauagacuucagaaaacuaguagaauucaaaaaagcacuaggaguacacucauuaucaagacaggaacuggaucaaaucucaacacauaucacacuaauuaaagacaauguaaaacuaaaaaccguucuagaaaaauauaauuuauccaaugaacaaaucaauaaucuccucgaaauagaauucaaugacuauauaaauuuaucuuuuaaagcccuuggcaugauccuacccuuaaugcgugaaggaaaaagguacuaugaagcaugcgaaaucacaaaccuaaaaccaaaaaccgucgaugaaaaagaagauuuccuuccagcuuucugcgauucaaucuucgcccacgaacuaaguaauccugucguaaaucgcgcaaucuccgaauauagaaaagucuuaaaugcacuccuuaaaaaauacggaaagguacacaaaauacaucuagaacuagcacgcgacguuggauuaagcaaaaaggcaagagaaaagauagaagaucaacaaaaaaacaacaaagcaauaaacgacugggcacuaaaagaaugcgaaaacaucggaauuaaagcaagcgcuaagaacauacucaaacuaaaauuauggaaggaacagaaagaaauaugcauauauucuggaaacaaaaucucaauagaacaucuaaaagaugaaaaagcccucgaaguugaccacaucuauccauacucuagaucuuuugacgacucauucauaaauaagguacucgucuuuacaaaagaaaaccaagaaaagcuaaacaaaacaccauuugaagcauucggaaaaaauaucgaaaaauggaguaaaauccaaacuuuggcacaaaaucuccccuauaaaaaaaaaaauaaaaucuuagacgaaaauuucaaagauaaacaacaacaagacuucauaucuagaaacuuaaacgacacaagauauauaacaacccuaauagcaaaauacacaaaggaauaucucaauuucuugcccuuaagcgaaaacgaaaacaccaaccuaaagucaggagaaaaaggcaguaaaauccacauacaaacaauaucugguaugcuaaccucagucuuaagacacacauggggauucgacaaaaaggacagaaauaaucauuugcaccacgcauuagaugccauaaucguagcauacucuacuucaucaaucauaaaagcauucuccgacuuuaaaaaaaaucaagaauuauuaaaagcacgauucuacgcaaaagaacuaacaucagacaacuacaagcaucaagucaaauuuuuugaaccauucaaaggguuuagagaaaaaauucuaaguaaaauugacgaaauauucguuucaacacccccacguaaacgagcaagaggcgcuuuacacgaagaaacauucuauucggaagacaaaaugaucaaaaaguauaauucaaaagaaggauuacaaauagcuuuaucaugcgggcgagucagaaaaaucggaacaaaauauguagaaaacgacaccaugguucgaguagacauauucaaaaaacaaaauaaauucuacgcgaucccaauauacgugauggacuucgcacuaggaauccuacccaacaaaauaguaauaacaggaaaagacaaaaacaacaauccaaagcaauggcaaacaauagacgaaucuuacgaauuuuguuuuucauuauacaaaaacgaccuaauacugcuccaaaagaaaaacaugcaagaaccagaauucgcauauuauaacaguuucgacauagauagaucaaggauaaaaauaaaaaaacacgauaacaaauuugaaaacuuaacaagcaaccaaaaacuacuauuuacaaacaaagacaaaggcaaaaaccgaacuggcauucaaaaccucaagauauucgaaaaauacauaguaacaccacuaggagauaaaauuaaggcagacuuccagccccgcgaaaauauaucauuaaagacuucuaagaagcauggccuauga

SEQ ID NO: 4902 - RNA, 2994 nt, Artificial Sequence
  Cas9 variant
auggguaauuacacauuaggauuggauauugguagcaauucaauuggaugggcauuaguugaagaugcggucgaggcaccacgcauaguagauaugggagugagaguauuuccggaaggcguggaccgcgacacgaaaggauuggaaaaaucgaaaaacgcaacgaggagagaagcacguggcgcgagacggacacaccagagaagaaggcaaagaaaacaaagacuugugagagcacuaagacaaguaggucuacugccaugugacaaggccgaaguaagaagccuguuucagaccgacccuuacgaaauaagaaaaagagguuuagaccauagauuagaacucuaugaaauaggaagggcauuuuaucaccuaucucaaagaagaggauucaaaaguaauagaaaaucaggcgcucucaaagaagacggaacggucaagaaagaagcuggagaguugcaaagaaaaauagaugaggcaggauguagaacuaucggagaauauuuugcaggccuagacccagaacagcaaaggauccgcggcagauauacuuucagaaguauguaccaaaaagaauuugaucuacuaugggcuaaacaaguagaauuuuauccgaaaguauuaacagaggauuuaagaucaaaaguacgcgaugaaauaaucuucuuucaaagaccacuaaaaagcgccaaagacuuaauaggagauugugaacuagaacccacagaaaaacgauguccucgagcagauugguaugcaaggagauuuagauuacuacaagauauuaauaauuuaauaauacaaaauccggacgguacagaacagaaacuaaguccagaccaacgagcagcacugcuuggcgaacuaggacaaagagaaaaacuaaccuucgauaacauaagagcaaagcuaggauuauuagaaacgcaaaaauuuaaugccgaauauagaauugguagaaaagguaagaaaguagaagcaauaaaaggcgacguauuugucuggacuaugaggggaaaaucgguuuuuggaccaaaagccugggaugcaauggcugaugaaagaaaaguuagcuuaaaugaauuguuuguagaguuagaggacgaugauuuagcuagaaaauuagagaccgaauauggcuuaacagauaaacaaguacaagcagcaaugaaggcuucucucccacaaggauacaugaguuucucaagaaaagcaguuuuaaaacuccuaccauuuauggaggcaggagcauuaacucaugaagccauagaucaagcaggauauagaaaagaagaaccaacacaaacagaugcaauagcaagaguaaguuuuccuccagaucugagaaaucccauagugcaaaaagcauuauucgaggugcgaaaaguggucaacgcccuaguacgagaguauggaaaaccgacaagaaucaaaauagaaauggcacgagacguucaagguagcaaaaggcaaagagaagaauugcauuggcgaaaugaagauaacagaaagaaaaacgaagaaguacgugacagauuaagaacugacauacacauagacgauccuagcagagacgauguaauuaaauauaaacuauggcaggaaagcgguaaaaugugcccauauacaggaagacaaauaugucaagaagcguuguuuggacccaauccagaguuccaagucgaacauauccuaccguaugacagaucucuagaugauuccuacaugaauuuaacauuaugcgaaguucaugaaaacauacauggcaaaagaaaucaaacaccauuugaagcauacggaaguggagcagaacgauaugaacaaauaaagcaaagaauuaaagucuuaccuuggccgaaaagacagaaauucuugcaacaagaaaucaaucuagauagccauauaagcagggaacuuaaugauacaagauacauaugcagagaaacaguagcauaucuaaagcaacuaggaguccauguaaggggaacaagaggaaaaauaacagcagaauuaagacaucaauggggauuagauggaauuuucagugaauuagguguacgaagagaugaugaccaccgacgacaugcaguagacgcauuggucgucgcugucaccgauaaugaacauuuacgucgauuagcggugaguaaauacguauuagcaggcccaagguuugaaacaccguggagugccuucagagaugaagcaagagguaacguaaagagaaugaauguaucgcaucgaguuuguagaaaaguuaguggugcgcuacaugaagagacaaacuacggaccgacgggcguacgagaucaagcaggacaagauauauacgcguauagaaagaaacuagaagacuuaacaaccccaaugguagagaaaauagucgauccugucguacgagacauaguuagacaaagauuauuaaugaagggaauagacccugcagcugcagacagaaaaauaccaaaagauguauggaaagaaccacuauacaugcguagaacaaaaucagauaaaaugauacaaauaagaagaguuagaauacacgauguuaaaaacucuauuauuguauugacagacgaaucaggccgaccauauagagcaguagaaccaggaggaaaucaccaugucgagguauucgaguacguacacgggacaaaaacugguacccgagaagccgaaguaguaacaauguuugaagcuguccgaagaucaagggcaagagcaccaguggugagaagagaucacgguccagguacaagguucguaugcucuuuagcaauaaaugacaugguuaugaugcccgacaaaaguggaaaaauggaucucuuuagaauacaaaagaugucagccagcaaacaaguauacuuuagacaucauacagcggcucgaaucgacagcgaaagaacauuaauaagaaaacaagcccaucuauucaauggauauaaagugucuguugacccuacuggagcaauuuguagagcaaaugauuga

SEQ ID NO: 4903 - RNA, 3000 nt, Artificial Sequence
  Cas9 variant
augaaaauacugggauucgauauaggaauaaacuccauuggaugggcauuuguagaagacaaucaauuacaagauuguggaguacgcuuauuuacaaaagcagaagauccaaaaaccaaagagucacuggcacuaccuagaaggaacgcaagaucaaacagaagaagauuaggccgcagacgaucacgacuaauugcauuaaaacauauaauuagcaaagggcuaaaacuaaacuaccaagacuacauagcuaacgacggagaacuaccaaaagcuuaugaaggacgcuuaauaucuccauacgaacuccguuauaaagcucuaaaugaaaaaaucgaaccaaaagaccuagcacgaguaauacuacacauagcaaaacaccgaggcuacaugaacaaaaacgaaaaaaagucaucagacaacgaaaaagguaaaauacuaagcgcauuaaaaacaaacgcacuaaaacuagaaaaauaccaauccguaggagaauacuuuuacaaggaguucuuucagaaauaccgagaaaacacgaaggacuucauaaauauaagaaauaaagaaggaagcuaugaaaauuguguauuagcuagugacuuagagaaagaauuaaaauugaucuuggaaaaacagaaagaauggggauacuccuauaaugauaacuucauaaaagaaauuuuaaaaguagcauuuuuccaaagaccucucaaagacuuuucuuaucucguaggagcauguacauucuucgaagacgaaaaaagagcuugcaaaaauaguuacucugcaugggaauucguagcacuaaccaagauaaucaaugaacucaaaucauuagaaaaagaaagcggagaacuggugucaucacaaaucauaaacgaaauacuaaaucauauauuagauaaaggcaguaucacuuacaaaaaauucagagaauauauaaaacuacaugaaucaaugaaauucaaaagucucaaauacgauaaggauaaugucgaaagcacgaaacuaauagaauuucgaaaacuaguagaguuuaaaaaagcacuaggugagcacucccucucaagagaagaacuugaccaaauugccacauacauaacacucauaaaagauaaugaaaaauuaaaaauaacauuagagaaauacucacuaaacaaugaacaaauaaaaaaccuccuagaaauagauuuuaacgaucauaucaaccuaagcuucaaagcccucaaucugauacuaccauuaaugaaagaagggaaaagguacgacgaagcaugcaaacugcuaaaucuaaaaacaaaauccaauaaucaaaaauuugauuuucuacccgcauuuugugauucaauauuugcccaagaauuaacuaacccaauagugaacagagcaauaagcgaauaccgaaaaguacuaaaugcacuacuaaaaaaauauggcaaaaugcauaaaauucacauagaacuagcuagagauauaggauuaucaaaaaagcucagagcaaaaaucgaaaaagaacaaaaagaaaacuacgagaacaacauaugggcccuaaaugaaugcgaaaaauucggucuaaaagcaaacgcaaaaaacaucuuaaaauuaaaacuuuggaaagaacaaaaagaauuuuguauauauuccggaaaaaaaauuagcaucgagcaccuucgagacgaaaaagcguuagaaguugaccauauuuacccauacucaagaagcuucgacgacucauuccuaaacaaaguuuuagucuucacaaaagaaaaccaagaaaaauuaaacaaaacacccuuugaggcauucggggcuaaugaagaaagauggaguaaaauacaggcguuagcacaaaacuuaccauacaaaaaaaaaaauaaaauacuggaugaagcauuuaaaggaaaacagcagcaggauuuuaucucgcgaaaccucaacgacaccagauauauaucgacacuuauaguuaaguacacaaaagaauaccuagacuuccuacccuuagaugaaaaagaagaugucaaccucaaaucaggagaaaaaggaucaaaaauucauguacaaacaauaaauggcaugcuuacaucaguucugagacacacauggggauuugcacaaaaggauagaaacaaccaccugcaucaugcccuagaugccaccauaguagccuacucaacaaacgcaauaauaaaagcauucucagacuuuaaaaaagaacaagagcuacucaaagcaaaacuuuaugcuaaagaacugacaagcgauucauacaagcaccaggcaaaauuuuuugaaccauucgaggguuuuagagaacaaauacuuaaccaaauaaacaaacuauuugucucaaaaccaccaagaaaaagagcacggggagcacuucauaaagaaacguuuuacucaaaagacgaaaugauaaaaaaauacaauucccaagaaggaguagaaauagccuuaaacugcggaaaaauaagaaaaauaggaacaaaauacguagaaaacgauacaaugguccgaaucgauauuuucaaaaaacaaaauaaauucuacgccauaccuauauacaccauggacuuugcauugggcguauuaccaaacaagauaguaauaauaggaaaagacaaaaaaggaaauccuaaacaauggcaggaaauagaugaaucauaugaauuuugcuuuagcuugcacaaagacgacuuaguacuuauucaaaaaaaagauaugcaagaaccagaauucgcuuacuacaacggcuucgacauuaguaauagcucaaucugcguagaaaaacaugacaacaaauucgaaaaucuaacagacaaucaaagguuauuauuuacuaacgcagaaggaaaugucaaagcaaaaaaaauaggaauccaaggacuacgaauauucgagaaauacaucauaacaccccuuggugaaaagauaaaagcagacuuuaaaccaagagaggacauagcauuaaaaacaucaaaaaaacacggauuauga

SEQ ID NO: 4904 - RNA, 3003 nt, Artificial Sequence
  Cas9 variant
augaagauauuaggauucgauauagguauaaauucaauaggaugggcauucguagaaaacgacgaacucaaagacugcggaguaagaauauucacgaaggccgaaaauccaaaaaacaaagaaagccuagcacuaccacgcagaaaugcacgcucuuccagaagacgacucaaaagaaggaaggcaagacuaaucgcuauaaaaagaaucuuagcaaaagaacucaaauuaaacuucaaggauuacgucgcagcagauggagaacuaccaaaagccuacgaaggcucuuuagcaucuguauacgaacucagauauaaagcacucacgcagaaauuagaaacaaaagaccuagcaaggguaauacuacauauagcaaagcauagaggguacaugaacaaaaacgaaaaaaaaucaaaugacgcaaaaaaaggaaaaauacuaucugcccuaaaaaauaaugcccuaaaauuagaaaauuaucaaagcgucggcgaauauuuuuauaaagaguucuuucagaaguacaaagaaaauacaaaaaacuuuauaaaaauaagaaacacaaaggacaacuauaacaacuguguccucucuucugaccuagaaaaagaacucaaauucaucuuagaaaaacaaaaagaauucggcuauaaguauucugaaggcuucauaaacgaaauacugaaaguagcguuuuuucaacgaccgcuaaaagacuuuucucaccuuguuggagccugcaccuucuuugaagaggaaaaucgagcaugcaaaaacuccuauucagcaugggaauucguagcauugacaaaaauaauaaacgaaaucaaaucgcuagaaaaaauaucaggagaaauaguaucuacacaaacaauaaaugaagugcuaaaccuaauauuagacaaaggcuccauaacauauaaaaaguucaggagcugcaucaaucuccacgaaucaauaagcuuuaaaucguuaaaauacgacaaagaaaacgccgaaaaugcaaaacuaauagacuuucgcaaacucguggaauucaagaaagcauuaggcgugcauuccuuaucaaggcaagaauuagaucaaauauccacacacguaacauuaauaaaagacaacguaaaacuaaaaacaguacuagaaaaauacaaccuaucaaacgaacaaaucaacaaucuauuagaaauagaauuuaaugauuauaucaaccuuucauuuaaagccuuagggaugauauuaccccucaugcgagaagguaagagauaugaugaagcaugcgaaauuacaaaucucaaaccaaaaaccguagacgaaaaaaaagauuuucuaccagcauucugcgacaguaucuuugcacacgaacuuucaaacccaguaguaaacagagccauaagugaauaccgaaaaguacuaaacgccuuguuaaaaaaauacgauaaaguccauaaaauccauuuggaauuagcaagggacguaggccuuagcaaaaaagcacgggaaaaaaucgaaaaggaacaaaaagagaaccaagcaguaaacgcaugggcucuaaaagaaugugaaaacaucggucucaaagccucggccaaaaauauacuaaagcuuaagcuauggaaagagcaaaaagaaauuugcaucuacucaggaaauaaaauaagcauagaacauuuaaaagacgaaaaagcgcuagaaguagaccauauauauccauauagucguaguuucgacgacaguuuuaugaauaaaguauuaguauucacuaaagaaaaucaagaaaaacuaaauaaaacaccuuuugaagccuuuggaaaaaacauugaaaaauggucaaaaauacaaacacuagcucaaaauuuaccauacaaaaaaaaaaacaaaauauuggacgaaaacuuuaaggauaaacaacaagaagacuuuauauccaggaaccuaaacgacacaagauacauugcuacgcuaauaaccaaauauacaaaagaauaucuaaauuucuuaccucucaaugaaaaugaaaauaccaauuuaaaaucgggagaaaaagguagcaagauacacguccaaacagucaaugguaugcucaccucaguacuaagacauacauggggauucgacaaaaaagaccguaacaaccaucuacaccacgcccucgacgcaaucauaguagcauacagcacaaacucaauaauaaaagccuucucagacuucaaaaaaaaccaagaacuacuaaaagcacgguuuuaugcaaaagaacuaaccagcgauaauuacaagcaucaaguuaaauucuucgaacccuuuaaagguuuuagagaaaaaauccucucaaaaauagaugaaaucuucguaucaaaaccacccaggaaacgagcuagaggcgcguuacacaaagaaaccuuuuacucagaagacgagaugauaaaaaaauacaacucgaaagaaggucugcaaauugcccuuucaugcggccgaguaaggaaaauagguacaaaauauguugaaaacgacacaauggucagaguagauauauuuaaaaagcaaaacaaauuuuaugcaauaccaauauaugcgauggauuucgcacuaggcauauuaccaaacaaaauuguaguaguaggcaaagauaaaaauaauaacccuaaacaauggcaaacuauagaugaaaguuaugaauucuguuucucccuguacaaaaacgauuuaauaaugcuucaaaaaaaggacaugcaagaagcagaauucgcuuauuauaaugguuucgacaucucaacaucuagcaucuguguugaaaaacaugacucaaaauuugaaaaucucacaaguaaucaaaaacuacuauuuuccaaugcuaaagaaggaagcguaaaaguagaaaaccucggaauacaaaaccuaaaaauauucgaaaaguacauaauaacaccauuaggcgacaagaucaaagcagauuuccaaccacgcgaaaacauaagucucaaaacaagcaaaaaaaacgguuuauga

SEQ ID NO: 4905 - RNA, 3003 nt, Artificial Sequence
  Cas9 variant
auggcaagggcucagagacguuuaauauccagaagagccaacagaaugaauaaacugagaagauuauuaaaacaagaaaauguuuuacaagcuaacgauuaugacgaaaaaggccuaauuauaggacuacccaaucaagcaugggaacuucgcgcacaaggccuagauagaaaauuagaaccaaaagaaugggccgcuguguuaauaaaccucguaaaacauagaggguauuuaagucaacguaaaaaugaaucacaaacagcagacaaagagcuaggagcccuauuaaguggaaugaaucauaaucaucaacugcuacaaucacaaaguaaucaauacagaacuccagcagaauuagcaauaaaacaauuugcgacacaagauggacauauuagaaaccagagaggagcauacacacacacuuuuaauagauuagaccuacaaaacgaguuaaaucagcuauucgacgcacaaacaagacuuggcaauccacacguaaguggaucccucaaaaccgcgauaaaugacuuacuaaugaaucaaaaagcagcauuaucuggcgacgcgauccuugaaaugcuaggacgauguacauucgaaccaucagaauauaaagccgcaaaaaauaccuacagugcggaaagauuuguauggcucggcaaacuuacaaacuuaagaauacaagauaauggauuagaaagcgcccuuucaagagaacaaagggaacuacuacuuaaugaaccauauaacaaaacaaaacuaacauaccaacagguucgaaaacuacuacggcuaccagaaacagccuuuuucaaaggucuaagauaugguaaagacaacgcagaaucagcaacauucauggaaaugaaaucauaccacgcaauaagaaaaucucuagaaaacaaaagucucaaaagugaaugggaaaaacuaaaaacucagccaaaacuccuugaucuaauuggcacugcauucaguauauauaaaacagaugaugaaauugccggaugucuaaaaaaucagcucccagaaaauguuauaauugcgcuacaagaacaauuaaauuucagcaacuuuauggaauuguccuuaaaagcacuagaaaaauugcuaccacucauggaacaagguuugcgauacgaugaagcaugcacgcaaauuuacgguaauagacacgaaaaaauagccgauaaaacagagaaauuccucccaaacauaccggcugacaaauuacgcaacccugucguuuuaagaacauuaacacaagcaagaaaaguuauaaacgccaucauucgaagauaugguagcccagccaggguacacauagaaacagguagagaaguaggaaaauccuuuucagacagagacaaacucaaaaaacagcaagaagaaaaucaagaacaaagaagacgcgcaauagacgaauggaaacaauuuuuuccaaacgcagcucacgaaccaaaagcagucgauauucuaaaauuaagacuauaucaacuacaacaggguaaaugucuuuauagcgggcuuccaaucgacgucagaaggcuaccagaaaaaggauacguagaaauagaucacgcacuaccauuuuccagaacaugggaugacucauucaauaacaaaauccuaguacuagccucagaaaaccaaaauaaaggcaaucaaacaccuuacgaauaccucagaggagcagacaacuccgaaagcuggcgacuuuuuguugaaaauguacaaaacugccaauuuaguccaaauaaaaagcaaaaaauaauggcaaaacagcuagaugaaaaaggauuuuuagaaaggaaccucaacgacacgcgauaugucagccgcuuuuuaugccaauucauaagugaacaucugcauuuaacagguaaaggaaagaaacgaguuuuugccucuaauggccaaauaacugcacuauuaagaggaagauggggauuaucaaaaaaucgugaagaaaaugauaggcaucaugcaguagacgcugucguaguggcauguagcacgguugcaaugcaacaaaaaauaacacaauucgucagauaucaaaaaggaaaugucuuuacuggagaacgaauagacaaagaaacaggagaaguaauauccauccauuucccaacucccugggaacacuucagagaagaagucaugauccgaguauucgacgauaauccacuacgcacauuaccagaaaaguuacccaacaggcccgaagcucuacacgaauacguuaugccucuauuuguaaguagaaugccaacaaggaaaaugacaggacaaggacacaaggaaacaauaaaaucugccaagcgccucgaugaaaaaauaagcguauuaagaguaccacuuacccaacucaaauugaaugacuuggagaacaugguuaacagagaaagagaaccagcacuauaugaagcucuaaaagcacgucuagaacaauuuaaaaacgauccugcaaaagcuuuugcugaaccauuuuucaaacaaggcggacaacaagucaaagcaguaagagucgaaauaguacaaaaaaguggcaugcuauuacguaaaauaaauggggucgccgauaauggaucgaugguaagaguagauguauucgaaaaaaguggaaaauuuuaccuaguacccaucuacgcguggcagguugcagaagguauacucccaaacuaugcagucgucgcacacaaagaugaaagcgacuggauauuaauggaugaaaguuaucacuuuaaauuugcauuauauaaaaaugaccuacuagaaguccaaacaaaaaaaggugguauaaugggauauuucgcaagcuuagaucgagcaacgggcgccaucacaauaagagaacacgaucgugauaaaaaaaaaugcaaagauggcgagcaucgaucaauaggagugaaaauggcaucauccuuuaaaaaacuucaggucgaugaacuuggcaaaaauauacacgaaacaagaagucgaaaaagaccuaauauaggauga

SEQ ID NO: 4906 - RNA, 3012 nt, Artificial Sequence
  Cas9 variant
augcgaauucuagguuuugauauuggaauaaacucuaucggaugggccuucguagaaaacgacgaacucaaagauugcggagugagaauauucacaaaagcugaaaacccaaaaaacaaagaaucacuagcacuccccagaagaaacgcaaggucaucacgacgacgauuaaaaagacgaaaagcucgacucauagcaaucaaaagaauacuagcaaaagaacuaaaacuaaacuacaaagacuacguggcugcugauggagaauuacccaaagcauacgagggaucacuagccagcgucuacgaacuucgcuacaaagcacugacacaaaaucuagaaacaaaagaucucgcacgaguaauacuccacaucgcaaaacauagaggauacaugaauaaaaacgaaaaaaagaguaaugacgccaaaaaaggaaaaauuuuaucagcacuaaaaaacaacgcacuaaaacucgaaaacuaucaaagcgucggagaguacuuuuauaaagaauucuuccaaaaguacaaaaaaaauacaaaaaauuucauuaaaaucagaaacacuaaagauaacuacaacaauuguguauuaucuagcgauuuagagaaagaacuaaaacuuauccuugaaaaacaaaaagaauuuggauacaauuacuccgaagacuuuaucaacgaaauacuaaaagucgcauucuuccaacgaccccucaaggacuuuagccaccuagucggagcaugcacauuuuuugaagaagaaaaaagagccuguaaaaacucuuacucagccugggaauuuguagcccuaacaaaaauaauaaaugaaauaaaaucuuuagaaaaaaucagcggagaaaucguuccaacacaaacaauaaacgaaguucucaacuuaauacucgacaaagguucgauaaccuacaaaaaauucagauccugcaucaacuuacaugaaucaaucucauucaaaucacuaaaauacgauaaagaaaacgcagaaaaugcaaaacuaauugauuuucggaaacuaguagaauucaagaaagcacuagguguccauucucuaucuagacaggaacuagaucaaauaucaacacauauaacacuaauaaaggacaauguaaaacuaaaaacaguucuugaaaaauacaaucuuucaaaugaacaaauaaauaaccuacuagaaauagaauucaacgacuauauaaaccucucauucaaagcccuaggaaugauccuaccccucaugagagaaggcaaacgauacgaugaagcaugcgaaaucgcaaaccuuaaaccaaagacaguggacgaaaaaaaagauuuccuccccgcauucugcgauaguaucuucgcucaugaacucucaaaucccguugucaaccgagcaauaagcgaauacagaaaaguuuuaaacgcucuccuuaaaaaauacggcaaaguucacaaaauccaccuagaacuagcacgugauguaggacuuucaaaaaaagcacgagaaaaaaucgaaaaagaacaaaaagaaaaucaagcaguaaacgcaugggcgcuuaaagaaugcgaaaacauaggauuaaaagcaucagcgaaaaacauacuaaagcuaaagcuauggaaagaacaaaaagaaauauguaucuauagcggcaacaaaauaaguaucgaacacuuaaaagacgagaaagcucuagaaguugaucauauauauccauacucuagaaguuucgaugacaguuucauuaauaaaguacuaguauuuacuaaagaaaaccaagagaaacuaaauaaaacccccuucgaagcuuuuggcaaaaacaucgaaaaaugguccaaaauucagacccuugcacaaaacuuacccuacaaaaaaaaaaacaaaauccuagacgagaacuuuaaagacaaacaacaagaagacuuuauauccagaaaccucaaugacacuagauauaucgcaacccugauagcaaaauauacaaaggaauaucuaaacuuuuuacuccuaucagaaaaugaaaaugcaaaccuuaaaagcggagagaaaggaaguaaaauacacguacaaacaauaagcgggauguuaacaucaguacuccgacacacauggggauucgauaaaaaagauagaaauaaccaccuacaccacgcucuagacgcuauaaucguugcuuacagcacuaacagcaucauaaaagcauucucagauuucagaaaaaaccaagaguuacuaaaagcccgauuuuaugccaaagagcuaaccagcgacaauuacaaacaucagguaaaauucuucgaaccauucaaaagcuuucgagaaaaaauacucuccaaaaucgaugaaauuuucguaagcaaaccuccccguaaaagagcaaggagagcccuccauaaagacacauuccauucugaaaacaaaauaauugacaaauguucuuauaacucaaaagaaggacuacaaauagcauuaaguugcggucgaguacgcaaaauuggcacaaaauaugucgaaaacgauacaaucguccgaguugacauauucaaaaaacaaaacaaauucuacgcuaucccaauauaugccauggacuucgcauuagguauacuaccaaacaagaucguaauuaccggaaaagacaaaaacaauaacccaaaacaauggcaaacaauagacgaaucguacgaauucugcuuuucccuauacaaaaaugaccuaauauuacugcaaaaaaaaaacaugcaagaaccugaauucgcauauuacaaugacuucaguauaucaacaucaucaauuugcgucgaaaaacacgauaauaaauuugaaaaccucacaucaaaccaaaagcuauuauucuccaaugcaaaagaaggaucugucaaaguagaauccuuaggaauacaaaaucuaaaaguauucgaaaaguacauaauaacaccccucggcgauaaaauaaaggcagacuuccaaccuagagaaaacauuagccuaaaaaccucaaaaaaguacggcuuaagauga

SEQ ID NO: 4907 - RNA, 3012 nt, Artificial Sequence
  Cas9 variant
augauagacgagagcuugaccuuuggcauagauuuaggaauagggucuugcgguugggcgguacuucgcaggcccagugccuuuggaagaaaagggguuauagaaggaauggguucaugguguuucgacguaccagagacaaguaaagaaagaacuccaacaaaucaaauaagacgaucuaauagacuauuacguagagucaucagaagaagaagaaacagaauggcugcaauaagaagacugcuccacgcagcaggucuacuaccuucaacugacuccgaugcuuuaaaaagaccggggcacgacccgugggaacuaagggcuagagggcuagauaaaccacucaaaccuguagaauuugcagucguauugggacacauagcaaaaaggcgaggauuuaagucagcugcuaaaaggaaggcuacaaauauaucauccgaugacaagaaaauguuaacggcacuagaagcaacacgugaaaggcuaggucguuaucgcaccguaggugaaauguuugccagagaccccgauuuugcaucaaggaggagaaauagagaaggaaaguaugaccguacaacugcaagagaugacuuagagcaugaaguacaugcauuauucgcugcccaaaggcgacuuggacaaggauucgcaagucccgaacuagaggaagcguuuacugcaagugcauuucaccaaagaccuaugcaagauucagaaagauuaguaggauucugcccuuuugagaggacugagaaaagagcagcaaaacuaacuccaaguuuugaaagauuccgacuauuagcuagguugcuaaaccugagaauaacaacaccagauggagaaagaccauuaacaguugaugaaaucgcucuugucaccagagauuuaggaaaaacagcaaaauuaagcauuaagagaguuagaacauuaauagggcuagaagauaaucaaagauuuacuacgauucgacccgaagaugaagauagggacauaguugcaaggaccggcggagcuaugacaggcaccgcuacauuaagaaaagcacuaggagaggcauuguggacagacaugcaagaaagaccagaacaguuggaugccauaguacaagugcucagcuucuuugaagcaaaugaaacaauaacagaaaaguuaagggaaauaggauuaacacuugcuguucucgauguauuacugacagcccuagaugcggggguuuuugcuaaguucaaaggagcugcacauauaucaacaaaagcagcacgaaacuuauuaccucaccucgaacaaggaaggagauaugaugaagcauguacaauggcaggauacgaccaugccgcaucaagacuaucucaucauggacagauuguugcuaaaacccaguucaaugcauuagugacagagauaggagagucaauagcaaauccuauugcaagaaaagcucucaucgaaggguuaaaacagauaugggccaugaggaaccacugggggcugccaggaucgauacauguagaauuagcaagagacguuggaaauaguauagagaaaagaagggaaaucgaaaagcauauagagaaaaauacagcgcuacgagccagagaaaggagggaaguacaugacuuauuagaccuagaagacguuaacggagauaccuuacuacgauauagauuguggaaagaacaaggaggaaaaugucuauauacuggaaaagcaauacauauaagacaaauugcugcaacagauaacagcgugcaaguagaucauauauuaccuuggucaagauucggcgacgacucauuuaauaauaaaacauuauguuuagccuccgcaaaccaacaaaagaaaagaucaacuccauacgaauggcuaagcggacaaacgggugaugcuuggaaugcuuucguucaaagaaucgaaacaaauaaagaacuaaggggauuuaagaaaagaaacuaucuacuuaaaaaugccaaagaagcagaagaaaaauuuagaagucgaaaucuaaaugauacacgguacgcagcgcgauuauuugcagaagcagugaaauuauuauaugcuuuuggugaaagacaagaaaaaggcgguaauaggagaguuuucacuagaccaggugcacuaaccgcagcauuaaggcaagcaugggguguagagagucuaaagaaacaagacggaaaacgaauaaacgacgacagacaucacgcauuagaugcauuaacgguagcggcgguagaugaagcagaaauacaaagauuaacuaaaucuuuucaugaaugggaacaacaaggucucggaagaccauuaagaaggguagagccacccugggaaaguuuucgagcagauguagaagcuacauauccagagguuuuugucgcuagaccagaacgaaggagagcuaggggagaaggacaugcagcaacgauaagacaaguaaaagagagagaguguacuccaauuguuuuugaaaggaaagcuguaucaucauugaaagaagccgauuuagagagaauaaaagauggggaacgaaaugaagccauuguagaagcaauaagaucauggauagcaacaggcagaccugcagacgcaccgccaagaaguccuagaggcgauauaauaacaaagaucaggcuagcaacaacuauaaaagcugccguaccugucagaggaggaaccgcagggagaggagaaaugguaagggcagauguauucucuaaaccaaauagacgaggaaaagaugaaugguaucuuguaccgguauacccccaucaaauaaugaauagaaaagcauggccaaaaccgccgaugcguucaauuguugcaaauaaagaugaagacgaguggacugaaguaggucccgaacaccaauuuagauuuucauuauaccccagaucaaauauagaaaucauucgacccaguggugaagugauagagggauauuucguaggacuacacagaaacacaggagcacuuauucccaccccaguaggaccugacucauaugugauagcauga

SEQ ID NO: 4908 - RNA, 3024 nt, Artificial Sequence
  Cas9 variant
augaaaguucugggauucgacaucggaaucaacagcauagggugggcauuuguagaaaacaacgaauuaaaagacugcggaguucgacucuuuacaaaagcugaaaacccaaaaacaaaagaaucauuagcacuaccaagacgaaaugcacgaaguucaagaguccggcuacgcagacgaagaaguaggcugcucagccuaaaacacauaauaucuaaagaauucggacuacacuacgaagauuacauugcacucgacgggaaucuaccaaaagcuuacaccggaaaaauagaaucaauauacaaauuaagauacgaagcgcuaagccaagcaauaagcaaagaagaccuagcaaggguuauccuucauauagcaaaacacagaggauauaugaacaaaaaccaaaaaacaucccaagauucagaaaaaggagccauucuaucagccaucaaagaaaauaguaacaaaaucaagcauuaucaaacagcaggggaauauuuuuauaaagaacuauucgagaaccuaagggaugguacuaaagaguucaaaaauauaagaaacaaagcaaugaaaaaugaaaaaacgggaaacauggaaucaacauacuauaauaccauacuagcaucugaucuugaaaaagaauuaaaacugauucuagaaaaacaacaagccuaucacaauuacagugacacauucauaaaagaaguauuggaaauagcauuuuaccaacgcccucuaaaagacuucagucaucugguaggcagcuguacauuuuacgaaaaugagaagagagcaugcaaaaacagcuauucagcaugggaauucauagcuuuagguaagauaauaaacacacuagaaucaauuaaaaaagacacaggagaaauauucagcaaugaaauaauaacacaaauuuuaaaagaaguacuagauaaaggaucccucaguuacacaaaauuaagaaaaaugauaaaucuagaugagaaaguaaaauuuaaaggauuaaaauaugacaaagaaggaguagaaaaaacgaaucuaauagaguucaaaaaauuaaaagaauucaaaaaagcacuaggcgaacacaaccucgaacgaaaaacauuagaugaaauagcaacacauauaacacucacaaaagacgaaaaucaacuaaaaaaacaacuggaacaauacgcacucucacagaaucaaauagaugcguuagccgaacuggacuucaacgaccauaucaacuuaucauucaaagcacuauacgaaauacuaccccuaauggaaaaaggaaaaagauacgacgaagcuugcaacgaacuuggacuaaaagcuaaaaccagcaaucaaaaaucagaguucuuaccagccuucugcgauuccauauucgcacaggaauuaacaaacccaaucgucaacagagcuauaagcgaguaccgcaaaguacuaaacagacuacuaaaaaaauauggaaaaaugcacaaaauacacauagaauuagccagagacgcagguuuaagcaaagaagcccguaacaaaauagaaaaggaacaaaaggagaauaaagacauaaacgacaaagcagaaaaaacaugcaaagaauucggauuaaaaccgaacgcgaaaaacauacuaaaaaucaagcuguggcgagaacaaggagaaauaugcgcauacucugggaaaaaaauaacaauagacgaccuaaaggaagacaaggcuuuagaaguagaucacauauacccauacucccgguccuacgacgauucauacaauaacaaaguccuaguauucauaaaagaaaaccaacuaaaacuuaaucagacaccauacgaagcuuucggaagcaaucaagaaaaauggagcaaaauacaaguuuuagcacaaaaacuaccauauaaaaaaaaaaauagaauacuagaugaaaacuucaaaaacaaagaccagauagaauucauaucaagaaauuuaaacgauacaagguaugcaacaagccuaauagcuaaauauacuaaagaauaccuagaauuucuaccauuaucggaugacgaagauauaaguuuaaaaucaggagaaaaaggaagcaaaacacacguacagacuaugaacgguaugcuaacaagcguacuaagacacgcaugggguuucucccaaaaagacagaaacaaucaucugcaccacgcacuagaugccauaauuauagcuuauaguaccaacucaauuauaaaagcauuuucagacuucaaaaaaaaccaagaaauacucaaagcaaaacuauacgcuaagaaauuaacaagcgaagaauacaaaaaccaaagcaaauucacuggauuugaaaaauacagaagcaaaauucuagaaaaacuagacucaauauuuguaucuaaacccccgaacaaaaacacuaaaggugcacuccacgagcaaaccuuuuacaguuaucaagacauacuggaagaauauaaaacccaagaaggccuuaaaagggcacuagaaugcgguaaaguacgcaaaauagguacaaaauacguagucaaugauaggaugguacgccucgauauauuuaaaaaagacaauaaauuuuacgguauacccauauauacuauggauuuugcacuaggaguccuuccaaauaaaguaguuacuaucgggaccgacaaagauaaaauaaaaaaggaauggaaaacaauugacgaaaccuacgaauucuguuucucauuauauaaaggugacuuggugcuuauacaaaagaaagaaaugcaagaaucagaauuugcuuauuacaauggauuugacauaucuagugcaaguaucagccucgagaaacaugauaacaaauuugaaaaucuaacagaaaaucaaaaauugcuauucccaaaagccaaagaaggugauguagaaguacgaggcauuggaauacaaggacuaaaaguauuuaaaaaauacaugguaaccccucucggggagauacaagagaccagaacagaagcacgacaaaauauacaaccacgaaaaaaacacggacugagauga

SEQ ID NO: 4909 - RNA, 3033 nt, Artificial Sequence
  Cas9 variant
augucugauucuucauauguacuagguuuagaccuuggaaccaacagcauuggaugggcauguguaagauuaaacaaaggaaaaccagauggacuauuagcgcaaggcguaagaaucuuugaagcaggauuggaaauagacgcguauggcagagguacaccauugaacacagaaaggcgaaacgcacgacaaagaagaagauuacaugaccgacgaaagaggagaauccuaaaagugaggagaauacuacaagaagcaggaaugcuaccagcuaauaagccagaucacaaagaugcugaguggaaaauguuacuugcacguaauccauacagauuaagagccaaggcuuuagaugaacaaaucgacuugaaagagauaggauuaugcauuuaucaauucgcacacagaagaggauuuuuaucaaauagcaaaauauuaaagaaagacgaugacagggguaaauuaaaagaugcuacuaaagcauuugcugaagacauggaacaaaaaggagcucgaacauggggagaauacuuaucucacuuagacccacacgaacaacgcauaagaacaaacuacacccuuagagaaugguauaccucagaauuugaccuaauaugggaaaaacaacaaucauuuuacccgcauguacuaacagacgacuuauauaaaagggucaaggaagcacuauuuuaucaaagaccauugaaaagccaagcccaucuauuaggccaaugcgaacucgaaccaggacgcaaacgcgcacccuuugcuuuguuaauggcucaagaauuuagauuauuacagagcuuaaaccaucuucgagugguaucaagcacaggcgaugaacgcuuauuaacugacgaagaaaggaaacaagcacuggcauuacuuagaagcagaggaaaccaaaaauucacaacacuaagaaaaguccuaaauuuaagaggaacaaaauuuaauuuagaacgagguggagagaaaacaauccaaggaaauaacacagcagcagcauugggaaaucuauuuggagaagccugggaccauuuuaguucugaacagaaaaaucaaaucguagaagacaggcuaacaaucggugacacagaugcauuaauacguagaaugaagaaaacguggggauuggacuccguaacugccgaaauguucagcgagaccgaacucgaagacggauauuguggauuuucgcgcaaagcccuagaaaaauuauuaccacuucuagagagagggcacgccuuaauggaagcgguacaagccgcauacccagauuaucagaaaaaucugccacgaacagauaccuuaccaccacuagaaaauuuaagaaauccaauaguucaaagaacccuaucugaacuuagaagaguagucaaugcaauaauuaaagaauauggcaaaagugacaaaauaagaauagaauuagcaagagauaugaaacaaaccgccaaaaacagggaaaaaucaugggaucggaugagaguacgcgaaagacaaagaaaagaggcagcaaagaaaauacuugaagaaacagguaaucccgcaccaaggagacaugaaauugaaaaaguccugcuagcagaagaaugcaauugggaguguccuuauacaggaaaacgaauauguaugaauacacuacuuggagacgcuccucaauuugacauugaacacauuaucccauucagccgaucauucgacaauaguuuuagcaauaaaacuuuaugcgacgucaauuauaauagaaauguaaaaggcaacaaaacaccauacgagagcgcaucagaaacagaacacgaagaaauggugugccgagucaagagauuuaccggagauuauaaagagauaaaauuagauagauuuaauaccagagaaacagacucaagggcagacuucauagaagaauuuuccacaucacaauuaaaugacacaagauaugcuucaagacucgcaggagaauauuuaggaaaguuauauggaagugaauggcgaaaacauauccaaauugcaaagggcgguacaacaaaauauuuacgugacgcaugggaucuaaacagaauacuaagcgauggaggaacuaaaucuagagacgaucacagacaucaugcgguagacgcugucguaguagcauuaacuacaccacaaaccguaaaagcccuaagcgacgcaaaucaaagagcaccagagcauagaagguacgcguucucagauaugccuuuaccgugggagacauuuagacaagacgucgaacaagcaauaaauucaauaacagugagucacaaaguaugucgaaaagcaaauggacaauugcacaaagaaacuuuuuauggacucaucaaagaucgaaaaaccggggacacaagaacaguacugagaaagccguuacacgaacucacagacaaagagauaaaaagagccgaaauaguagauagcuccauacgaaaacuaauagaacaaaaauuaaaagauuuagaccaaccgccaaagacagcauucaaagauagaaauaaccauccauucaucauugacaagaacgguaauaagcgauucauacauaaaguaagaguguaccaagaugcaaaaccggucaaaauugcggaaaacagacacgucaaauuaggaggaaaucaccaucuugaaauauuugaaguaauagauaagaagggaaauccaacauggaaaugugaaguaauauccuuauuugacacuagacaacgagucaaagaaaagagacccgucaucguuagacaagaucaaaauggaaauccauuaaaauucucauuauccaucggagaagcaguacaauuagacuggaacggaggaagagaaacagcaguuguacaaaagaugaguaaaacaccgaauacugucgaauauguauuuagaaaacacaaugaugcucgcaaagcggcagacauaccauauaaagaaacaaucacaguaaaaagcgauagcgcccucuuugcaucaaacuuacagaaaauuguaauaacucccacaggccuuauacgacgagcaaacgauuga

SEQ ID NO: 4910 - RNA, 3033 nt, Artificial Sequence
  Cas9 variant
augaaaaauagaaauguaauaggcauugauguuggcacuaacucgauuggaugggcccuaguugaagagaacgaaaaugguuuaccacaaucucuaaaagcagcaggcguaagaauauuccaagaagcaguagaagcaaaaaccagaacucccaaaaaucacaaaaggagacaagcaagacuagcuagacgaguucuggcgcgcagagcaagaagaaaacaaagacuucaaaaucuacuauuaaaacauggacugcucccaggaggaguaacagacccuguccaaagagaagccgcuuucaccacacuaggagauccuuaucaguuacgcgcaaaaggacuaaaucucccguugggucuacaugaauuuggacgcguccuauuucaacuaggcgcaaggagaggauuuuuaagcaacaggaaaacuagauauggacaccuuaauaaacuagacgaguuagcugauuuaauugaagcagaggacgcagcacccaaaacuggagaugcagaagaaggaauaauucgaaaagaaauaggagaauuaagacaagcgaugucagcagccgguagcagaacccugggcgaauauuuagccggcuuagcgaaagaagaaaggaaaagaugucgacauacagaacgugcaauguuagaggaagaguucgaacgucuuuggaugguacaagcgagauuucauccugaauugagugacgaacuaaaaguacaaguacacacugugauauucuuucaaagaccccuuaaaucaaaucgagccaguuugggaaaguguagccuagaaccaucaagaagaaaagcagcaagagcauggccagaagcccaacgauuuagguuacuccaagacuuaaauaaccucgaaauauuggauccaagaacgggggaauuaagaagauuaagagacacagaaagagcuauuuuguugaaugcucuagaacaacaaaaaucaaugacauggaacgcuguaagaaagaaauuaggccuucaucaaggugaaaaauuuaauuuagaaaccggggcaaaagcugaaaccggucuaaaaggacuacagacccuagcaucauuacaugcaaucuuacaggggugguucgacgaacuaggagauaaaagagaucugcuaauagaagaccuaauaacaauagaagauagugcaggacuauacagaagauuacgagagcauugggguuucgauagagaaacagcguucagauuagcgacauuagaacuagaaccgggauacgcaucccuaucacugaaagcaaucagaaaauuauuaccgcauaugggagcuggccauagauacucggaagcccgacaacaaguggguuacggauaugaaacaggacaaagagauuuacaagaaagauuaggagaaccaccagauccuagaaauccaguaguagauaaagcccugcacgaacuacgccgaguaauaaaugcauuaauacauagauuuggaagacccgauguaguaaggguagagcuggcaagagaucugaaauuagcaaaacgagacaaagaaagacucgaaaaacaaaauagagaaaaccagagacugaacagaaaagcagaagcagcacuagcagaauuagguuuaggacagcccucacgagacgaccuaauuaaauauagacuuugggaggaaucgaaaggccuaugucccuauaccggaagagaaauaggccuaaguaccuuauucaguccggaaguagaugucgaacacauuauacccuacaguagaugccuagaugacucauacaugaauaaaacauuaugcaugacagaagaaaaccgaaugcagaaaggaaaccgcacaccaugggaggcauacggcggcgacccagcaagauaugaacaaauauuacaaugcgcgagauauuuuccuauggccaaaagaaaaagauucuuagaacagggcucagauuuuguugaccaauucauacaaagacaauuaaaugacacgagauacauagccaaauuagcgaaagaauaucuagcagcugucuguaccaauguccaaguaacaaaaggaggaacaacagccaugcuaaggcaucacuggggauuaaauaggcuauuaggagaggaugauggucaaaaagagcgaggagaucacagacaucaugcacuagacgcagcagucauugcagucacuucacgaagucucuaucaaagacucgcucgcaucgcacaccaaagaggucaugcgccaagucaaaggggguuuuauauagacccaccuuggcaaggauaucaagcggaucuagcucaaacauuggccggaaucguuguaucccacgcuacuaauagaaaauuaacuggagcacuacacgaagaaacagccuacggucacauaccgcauguagguuuuguuuauagaaaaacacucaacaaagauuucaaacucggggacauagaagcuauauacgacccaucauuacaagaauuagucaaagcgcauuuagaacaucacggaaaugacccuaaaagagccuuugccgaaggaauccaaugcuaucauaaagacggucacacaccuauuaaacgaguaaggauucgagcaaagcaaguaucagaaaaaggaacauuuaguauuagcgauagggcuggcagagccuauaaacaucauaagacaggaagcaaccaucaugucgaaauuuuaagacacagagcgacuggaaaaauagaaccaguauaucucacuacaaaagaagcuacagaaagagcacgcagagggggcgaacccgucauacaacgugaucauggcccagaaugggaauuuauaauaagucucugcaucaaugauaugguacgacuaggagaaggaggacaagucgcguacuuucgcguacagaaaauugaagcaacgaauaauagggucacccuuagaagucauuuagccgcuacucuagacgacgaagauaugaaaguuacaacaucaguuccuaagcuagcaguaaugcccggcuuccaaaaaguauuaguuacagcaguuggagaaguuuuagaacuucacgauuga

SEQ ID NO: 4911 - RNA, 3033 nt, Artificial Sequence
  Cas9 variant
augaagagaauggcagcagucggacuuaugccagcagauccuacagaagcaaaagcacucgaauuacuagauccauaugcacuaagggcggcaggcuuagaucaggcccugccucuaacccacuucgggagagcauuauuucacuuaaaucaaagacgaggauucaaaaguaauagaaaaacggacaaaggagauaacgaaagugggaaaauaaaagaugcaaccaaaagacuagaugaagaaauggcuauuaagaacgcaagaacauauggugaauuuuuacauaugagaagaacaucagcaaccgauccgaaaaauguaccaacagucagaacaagguugucgauagcacgaagagauaacgccgaaaaagaagaagccgguuaugauuuuuacccagaccgaagacauuuggcagaagaauuugauaaguuauggaaagcgcaagcaggauacucaccagacguacuaacagacgaauuaagagaugaaauaaguguaauaauauuucaucaaagaccauuaaaaacgcccgaagucggacuaugucuauuuuccggcucacacggcguaccuaagaaagauaaacggauaccuagugcacauccauuaaaucaaagacgaauacuauuugaaacaauuaacaauuuacgcguagcagcaagaggagaaccagccagaggucuuacaagagaugagagggaugcaauaguacacgcauuagauaauaaagcgcauacaaaaucacuaucaggaauguccaugaaacuaaaggcauuaggaaaaguaauaaaauuaagaccagaacaaaguuucacucuacaaacggcgaauagagaaacaauugcaugugauccaguaagagcaagccuaagucauccagaucgauuuggcccuagauggaguaugcuggaugcugacgcacagugggauguaguacaaaggauaagagcaguucaaucagaagccgaacacgaugcuuuaguaaaauggcuaauggcaacacacggguuagauagagaccaugcagaaaguacugcaaaagcacccuuaccagaaggauauggaagacuaggauuaacugcuacaaaaagaauacucgcugcacuagaagcagauguaauaccauauucagaugcaguaaaggcaugcggauggcaucacuccgauggacgaacaggugaaguacuuacagaauuaccauauuauggucaaauauuggauaggcaugugauaccaggaacauacaacgaaucugaugaugacguuacgagauacgguaggauaacaaauccgacuguccauauugguuuaaaccaauuaagaaggcuagugaauaaaauaauaacaguauaugguaagccagaugagauuguaguagagcuugcaagagaccuaaaauuaagugaagaucagaaaagggauguacaaagagauauaaagaaaaauacagacgcagccauagcgagaggugcgaaauugucagagauggguguacccgauacuggagcaaauaggaugguacugagauugugggaaaguuugggugaugacguaaugacacgcaauugcccuuauucaggcaaaagaauuucagccacaauguuauuugauggcagcugcgauguugaucacauuuuaccuuacucaagaacacuugacgacggauuugcuaacagaacacuuugucuaaaagaauuuaauagacaaaagacagauaagacaccaugggaagcauggggagauacuccagcaugggcgacaauagaagcuaaccucaaaaaucuaccggcaaauaaggcuuggagauuugcaccagaugcuauggaacgauuugaaggagaaaaugacuucaccagucgugcacuaaaagaugcacaauaccuuucuaggauagcccgaacguaucuggacgcacuauaugauggagcagauggaaaaagucauguauggguuguacccggaagacugacugaaauguuaagacgucacuggggauuaaauucguuauuaccagauaaagacggugcaguaaaagcgaaaaauagaacagaucaucggcaccaugcaauugacgcagcaguagucgcagcaacagauagaucuuuaauccaaagaauaaguaaaauggcgagaaaagaugaagugaacggagcagaagaaguagcuagaucgguuccuccaccgugggaaggauuccgcacagauauagaaacucaauuggaccggauaauuauaagucauagagcagaccacggaagaauagaccccgcagcaagaaaagacggacaugauucuacaucaggucaauuacauaaugacaccgccuacgggcuuggagaagguaacagcgugguuuccagaaaaccauuauugagcuuaaaaucuaaugauauagaagugacaacaaaaggcgcgaauauaagggauguagacuuacaacgucauuuagagagaauaacaagaggauuagacggaaaagcccuggaagcggcauuagcagaguucgcugcaacugcgaaacuaccagacggaacugauaauccauauuacggcuuaagaagaguacgucuagaagaaacgcuccaacaaggagcaagaguggaaguaaaagauagaaacggaaaaccauucaaagccuauaaaggugauucaaaccauuguuaugaaauauggaggaugccagauggaaaaguaguaccucaaguuauaacaacauaugaagcacaucagaucgauguugaaaagaaaccacauccggccgcaaaaagauuguuacguauauuuaaaagagauauggucgcgauugaacaagaugacaaagcaauuauuggguacguccaaucgaugcaugucgccaauggccuauuuauugccccgcauacagaagcuaaugccgaugcaagaaguagagauaaaucggauaguuuuagguuaauccaaaugucagcaggaccgcuaguaaaagcaaaugcaagaagaguuuauguagaugaaaugggaagacuaagagauccaggcgccccaucauga

SEQ ID NO: 4912 - RNA, 3039 nt, Artificial Sequence
  Cas9 variant
auggcaaauaugcguuacagauuggcgcuugaccuaggaagcacaucauuaggaugggccaugguaagauuagacgcccaaaacgaaaccugugcaguaauaaaagcgggaguaagaauuuucagcgauggacgaaacccgaaagacggaaguaguuuagcaguaucacguagagaagcaagagcaaugaggaggaggagagauagacugcuuaaacguaaaacaagaaugauggcaacacuaaugaagcacggcuucuucccacaagaugaagccgcuagacaagcauuaguaaauaaggaaccauucgcccuaagagcaaaaggacuagaccaugcacuacuaccugaagaauuugcaagagcacuauuucacauaaaucaaagacgagguuuuaaaucuaaccguaaaacagauaagaaagaaaccgacaguagugcucuaaagaaagcaauaggacaacuaagggaagcuaugcaagcaucaggauguagaacagucggugaaugguuaugugcuagacaucaacaaggcuuaucaguucgugccagauaucgagaaaauagaauaacuaaagaugaugguaaaacaaaaauagagaaaucauacgacuuauauauugaucgagcgaugauagaggcugaauuugaugcccugugggcaaaacaaucagaguuaaauccagaguuauuccacgaaacugcucgugcagaguuaaaagauugucuauuacaucaacgaccgcuaaaaccaguuaaaccuggaagauguacuuugcuaccagaugaggaaagagcgccacuugcgcuaccgagccaacaaagauucagaauauaccaagagguaaacaaucuuaggcuacuacgagaaggauuaaaugaagaaccauugacauuaacacaacgcgaucaauugauacaggcuuuagaaacaaauccaaaacgaucauuuacacaaauacaaaaauuauuaggauuuaguggacaauucaaucuacaagacgauaaacguacagaauuaaaaggcaauagcacaagugcuaugcuuagcaagaaagaauuuuucggaucacaauggcuaucauuugaugaaacucaucaagaugaaauaguaaugcaauuaguaagcgaagaaaacgaagcacgguuaauagcuuggcuacaagcagagacaggagucgacgaaaucacugcagagagaauagcaaauaccccauuagcagaaggauauggaaguuuaucagcaaaagcauuagagaaaauccucccagccuuacgagcagauguaauaaccuaugauaaagcuguauuagcagcuggauuugaucaucacagucauauaucacaugcagcaacaggugagaucuuaccagauuuaccauauuacggacaauaucuacaaagacacguaggauuugguacaggcaaaccugaggacccugcagagaaaagauaugguaaaauagcaaacccaaccguacauauaggauuaaaccaaguaaggaccguuguaaaugcacuuauaaaaagauacggacauccuagcgaagugguaguggaauuagcacgcgaucuaaaacaaagucaagaacaaagaaaagaagaacaagcacaacaagcuaaaaaucaaagaagaaaugagaggaugagacaagauauagcaggccuauuaaacacaaguaccgagagaguaagggcauuagauuuacagaaaaugauucuuugggaagaacuaucguuuaaugucgcagacagaagauguccuuauaguggugugcaaauaagugcacaaaugcucuuuagugaucaagucgagauagaacauauccuaccuuuuagccaaacacuagaugauucauuaaauaauaaaacuguagcaaugagacaagcgaaccgaauaaaggguaaucgaaccccagcagaagcagcagccgauuuugcagcacaaggcuggccugucgaagauauguuacaucgugcuucuuuaaugccaaaagggaaacgauacagguuugcucaagaugggauggcacaaugguuaagagaagauaaaggcuuuuuagcaagagcacuuaaugauacacgucaucuaagcagaguagcacgagaauauuuaaguuuagucugcccacaaggaacccgaguaauucccgguagaaugacugccaugcuaagagcuaaauucggucuuaaugauauacuuggccuuaacggugaaaagaauagaaaugaccacagacaucaugcaguagaugccuguguaauugcgguuacggaucagucgauguuacaaaaauucgcaaaagcaucagccucagcaagggaaaagcaacuaaauaaauuagucgaaucaaugccauuaccuugggacucguauagggaccacguacaaagagcaguggagcgaauauggguaucucauaaaccagaucauggacaugaaggagcaaugcauaacgauacugcauauggacucuuagguggaggccacguucaaguuagaaaaaggauggauggugugagaacacgagaaacagcugcauuaaaaguuauagaguucgcugaccgacaagcacauccacgacauggauuauugccaaacggagaaccaaugccauacaaaggauauaaaggcgauucaaauuacuguauggaaauuguucgaaaugauaaaggaaaaugggaaggagaaguagucaguaccuuugaagcguaucaacugguaagacaacaugguuuagcaagacuccgacauccggcguuaaguguaucagggaggccacuuguuaugcgacuauugaggaacgacacauuaagaguaauacacaacggugaacaacgaacaguaagaauaugcaaaaugacggcggaaggaguaaucgcauuagcagauaccacagaaucgaacguggaugcaagaacgagaaccaaagauuuaucauauauauuuaaaaccgcuggaucacuucagaaaaguaaagguagacggguugcaauaagcccuucaggagaaaugaaagauccuggauucuucgacuga

SEQ ID NO: 4913 - RNA, 3051 nt, Artificial Sequence
  Cas9 variant
auggaagucuuuguagauguaagcgcaaggcaauuaggcauagauuuagguauaggaacauguggcugggcucuccuggcugaagauucauuaauagccuuagguacaagaacauuugauguuccagaaacagauaaagaaaggaucccgaccaaccagauccgacgucaagcacguggcaugagacgaguaauagaucgaagacgacaaagaaugaacgcugucagaagacuguuggcagaucauggucugcucgcagaugggggaaaauuaggccucgcaacaguuagacucgauccauggcaagcaagagccgaaggucuagaucguuuacuuagugcuggugaauuagcaguugcacuaggacauauagcaaaacaucgcggauucagaaguaauagcaaaagggaccgaggcgcuaaugcuccuaaagaaucgucugccaugcugggagcaauugcacaaacgggagaacgacuccaacauuggcgaacgguaggagaaauguuuuggaaagacgaauuuuaccaaacaagacgaagaaauagagauggagauuauaguagaacuguacaaagauuagauuuagaaacagaaguucacagguuauuagcugcgcaacgacgccugggaaacccauuagcaacauuugauuuagagcaaaguuuuauagacguagcauucuuucaaaggccucuagcggacagcgaugauaaggucgggccuugcccauuugaaccuucagagaaaagggcugcaagacauucgccgucguuugaacgauuuagacuguuaagucgauuagcugcacuaagacuaucaaguggugcuggagaaaggccauuaagcgacgccgaguucgcagcugccugugcagacuucggaaggcuacaaggauuuucauucaaaagauuaaggcagcauuuaaaacuagauccgucuaucagauuugcaggaauagcacccgaugaagaaggaaaaagagauguaguagcuaggucgggagaagccaccccgggaagugcagcauuaagacauuguuugggggacacaguuugggauaauaugcuuggaacacgacccgcauuauuagaugcaauagcagccauacucacauuucgagaugaugcagauagaauagcggaaggauuagcagguuuaggaauagaagaaccgauuuuagaugcauuaauggaugggguuagaaacgggucauuuggaaaauuuaaggggccaggacauauaucagcuaaggcaugcagagcauuacucccccauuuagcacgagggagaguauauucagacgcaugcgcugaugcgggcuaugaucacaguaggcaaacugaaacaaauuuagacgauauaagaaacccaguagcaaggaaagccuuaggugaagcauuaaaacagauaaagauuauaauccauacacacggaaggccaacagcgauacacguagaaauggcaagggauauagguaaaucagcagaugaaagagacgaaauaaagaaaggaauagauaaaagaaacucagaaaaagauagagccaggcagcaauuccacgaaaugguuggaacuccagcagccggugcagaagauuuguuacgcuuugaacucuggaaagagcaaaauggaugguguuuauacacaggaagagagauaccaauugaugcacuggugucaucagacaaucgaauacagguagaucauauauuaccauggagcagaaguggagaugauucauauauuaauaaaacacuaugcuucacugaagcaaaccaacacaagaaagguaugacaccaugggaaugguuacacgaugacccagaacguugggaaaaauucgccagaacuguugaaggcuguaaaacuaugaaaggaaggaagaaaagaaauuuguuauuaagagacucgucuagauuagaaaaagaguucagaucccgaaauuugaaugauacacguuaugcauguagauuauuauuaggaauauuaaaacauacauauccugauauaguggucgccgccaggccuggccccuuaacagacagauuacgacgagcuuggggacuacaaucacuaaagaaacaugaagauggaacccgaaaagaugaugauaggcaccaugcucuagacgcugcaguaguggcagcaacaucacaaaguauguuacaacgauuaacaacacuauuucaaaaagcugaaagagaagguggaagaagggacuucguaggacuggaaccuccauggccagguuucagggcagauuuagaagcaaaauuagaaggggugguaguaucgcgggcggaacgaagacgagcaagaggugcaggacauaaagacacgauaagagccauaggagaaggugacgcuggcccaguaguguacgagagaaaacccguagcagcuuuaacagaaaaagauuuagauagaguaaaggacccggaaagaaauaaaguguugaucgaaaauuuaagacaauggauagcagcgggaaaaccuaaagaucccgacaaggccccacgaagcccaaaaggcgauccaaugacuaagguaaaauuaguaacaacagaugacguacgaaucuuaguaagaggcggaacagcugauagaggggacauggcccgaguugauguauuuagacaggcggauccaaaaggaagauggagguuuuucuugguaccaguauauccacaucaaguauuugacccuacugauuggccucaaccuccuaauagagccgugguagcauauaaaccagagaaagaauggacgguuaugggaccggaccaugaguucuuaugguccuuauacccauuuucauggauugcgguagaaaaagcagauggaacaagaaucgaaggauacuuuagagguaugcaucguucuacgggagcaaucuccauaucgccccaccauagcaagagcuuagcaucaaccggaauaggagcaaaaacccuagcaaguuuuaggaaauuugcaauggacagaauggguaacuuaucagaaauagaaagagaaguacgaacuuggcaugggguagcauguacguga

SEQ ID NO: 4914 - RNA, 3054 nt, Artificial Sequence
  Cas9 variant
augagaguagauucauuaggaagguguuuaucagaugaagaaugggcuagaguuauauaccauuuauguaaacauagaggauuucauuggauaucaagagccgaagcuaaacaaacagaaggagacaguaaaucagaaggagggaaaguuaaacaaggcuuagcaggaacagcaaaacuaauggacgaaaaagguuaucguagcgcagcagaaaugguauuagccgaguucccagaagcacagaggaauaaacaaggagaauauagaaaagcucuaucaagagaacuacuagcaaaagaauuagcacucuuauucgccagacaacgaguuuuuggaaacagacaugcaacggacacauuagaaacagcuauacuagguaauucagauaagaaaagcggccuauuuuggcaacaaaaaccagcucuagcgggugcagauuuauuaaaaaugcuaggaacauguacuuuugagaaaaaugaauaucgugcaccaaaagcgagcuuuacggcagaaaggcauguguggcuuacaaggcuuaauaaucuacgaauaguaacggacggaauaacacgacaauuaacagaacaggaacgacaauuaguacuaccacuucccuaucgacaagcaggggauuuaacuuauaaacaacuaggaauggcauuaacaaaagcaggauuacuugaagcaggauguuuuaaauuuauagguuuagcguacccaaccgaagcgcaaaaagcggaagguaaaacuaaagauccagaaagcgcgacccucguaaaaauaccggcauggcaagaauuaagacaaacauuaaacaaagccagucuaaaugacgaaugggaaaaacuuucaggagaugcccuuugcggucagccagaaauauuugauaaaauagcuuggauacuuucaguauacaaagaugaugacgaaguacgaacagaauuagccaaauuaguacugcccaacccagaaggacuaaccgaagcacuacuuaauauaagguuugauaaauuccaugcauuaucacucaaggcuuuaagggcaauagucccacacauggaaaaagguuuaagauaugaugaggcuuguguucaagcggguuaucaccauucacaauuacacaaaauaggagaaggcgaacauaaauaccuaccuccuuuauacgaugguagagacggagaugguagaaugauuuuugcggaagaugccgauauaccacgaaauccaguaguauugcgaaguuugaaucaagccagaaagguaguaaacgcgauuauuagacguuacggauccccuucagccguacauauagaaauggcaagagaucucaguagaccauuugacgaacguaacaaaaucaagaaagaucaggaugaauaucaagcaagaaaucaaagagauagggaacaauuuauagaauuguuuggacauccaccuaaaggacuagaguucgaaaaauggcgacuauauagagaacaaaauggacaaugugcauacucacaaaaacccuuagcaagcaguggagaugucgcugaaauuuuucuugacggcucuacagaaauagaccaugcauuaccauauucuagaucuuuugaugacaguaaaaauaauaaaguauuaguacuuacacgagaaaauagagauaaaggaaaccgaacaccguaugaauaccuuggaggagcagaaaacucagagcguuggcaaagauucuuuaguuuuguagaauccaauaaagcauaccgacuugcaaaacgaacgcgucugcugagaaaagauuuuggagcaaaagaaucagaagaguucagagaacgaaauuuaaacgacacacgauaugucugucgcuucuuuaaaaacuauguagaacaacaucugaaacuugcugaaggaucagaagccaaaagguguguagucguaucaggacaacugacaaacuuucuacgaaccaggugggguuuauuaaaaauacgaagcgauucugaucgacaucaugcauuagacgccgcaguaguagcagccugcucacacuccaugguacaaaggcuaagcaacuauaguagaacacgagaacuggagcagguacgagaugguuuugucaauaucgaaacuggugaaauaguuaauccugcuaugcaccaacaacuccgugaacauuuuccugauccauggccguauuuuagacaugaauuagaagcucgacuaaaaauagauaguccagcuuuauuacgcgaagaaauggcaagacugucuagcuacacagaagaagaacuagcagcacuaaaaccacuguuuguaaguagggcaccucaaagaagaaaugguggugcugcacauaaagacacaauuuauggacaaccagaaaaacuaaagaaaaacgguucuguaucacaaaaaguugcacuagccucgcuugcguugaaagacaucgauuuauuggccgauccccaucgaaaugcgaaauuauauggagcaauaagggaaagacuagaagcccauggaggaaaaggggauaaagcauuucccgccacaaauccacucaggaaaccagacaaagaaggcaauccaacagguccaauuguuagaacaguaacuaaagucaucgauaaacuaagcggaaucccaguccgaggaggaauugccaaaaaugacacaauguuacgaguagacguguuuacaaaagcaggcagauuccauuuagugccuguuuauguucaucaucgagucaccggauuacccaaccaagcaaucaccagagguaaagaugaaaaucaaugggcgauaauugaugauacauucgaauggcgauuuucauuauauccuaaugauuuaguacaaauaagacucaaagaugaaacacaucucggcuacuaugcaucaacugauagaaguacaaguucaauaucaauuugggcucaugacagaaaccagucaguaggaaaagaugguuuaauucgaagcauaggaguaacaacagcgaaagacauugagaaauuucauguggauacguuaggaaacguauacccugcucccccagagaaaaggagaggacucgcauga

SEQ ID NO: 4915 - RNA, 3066 nt, Artificial Sequence
  Cas9 variant
augagaagaagaagagauagguuuaaacagagacaggcagcguuauuaaaacauuuggcaggaguaggauuauuuccagcagacgaagcugcacgcagagaauuagcugguuuggauccguaugagcuaagagcgagagcacuucaugaagcacuaccacugaaccauaucgggagggcucuauuccaccuaaaccaaagacgggguuuuaaaucaaacagaaaaacugacagagguaaagcugaugaugaagguaagaucagacuaggcguugcacgauugcaagaggcaaugcaugaaaaaggcagugcgacauuaggagaguucuugcauggaagacgagcagcagcaacagaucccaaucaaauuccuagcguuagaacaagauuaagagcagaaaguggcgaaggcgcaagaggagaugguuaugauuuuuacccagauagaaggauguuagaggacgaauuugaagcaauaugggaaucacaacaagugcaucacccagcaguucuuacugaugaaauaaaacaaagauucuuugaaguaauauuuuaccaaagaccgcuaaaacaaccagaaauagggacauguacacucguagcuggcgaaagaagauuaccaaaagcucauccacuauuucaaaagagacgauuauuagaggaacuaaaugcuuuaagaaucguuuggccaggaguacaagccgaauuguuaucacgugaacagagggaccuagcauaccugaaauuaaaagauaaaagggcaguuagauuugaaucacuaagaaaagcacuaaaauuggauccugaugcaagauuuaauaaagaaagugaaaaccgaagugaacuaaagggugaugaaguggcagcagaacuaggagccaaaucgcguuuuggaggaagauggggacacacggcaccagcggaccagugggaaauaguuuccagaauacaagccuuggaaagugaugaugacgaagcacaauucuguguuuggcuaucugaaagauauggucuagauagcgagcaagcaagggcaguagcagcagcacgauuaccacaagguuucgggcguuuugggcuuacugcaacuacccgcuuaauuaaggcuuuacaagacgaagucauuguauacucagaagcaguacaaaagacuggacuugggcaccauagugacuuucgcaacggagaaguauuggcagaacuccccuauuauggaaucgcgcuagaaagacauauaaugccagguacaggagauccuggagauagcgaugaaaugagagugggucgaguaacaaaucccacgguucauauaggauuaaaucaauuaagaagaguaguaaaccgauuaauaaaaagauacgggccucccagacagauagcaguugaauuagcacgugaauuaaaacuagaugaucaacauaaaagggagauaaauggaaggaauagacaaaauagggaagcagcggaacgaagaagucagaaauuaguagauauagguauugcagacaaaggagcaaacagggcauuauugaaauuaugggaagaacuaaauccagauaaugccuuggauaggagaugcguguacacggggagacaaauuucuauagaaauguuauuuaguggggcaguugaaguugaucacauauuaccguuugcagcaacgcuagacgacagcaaugcaaauaaauuauuaugcuugagggaagcaaaccggaacaaaagaaggagaaguccauucgaagcauuuggucagggagcagauugggaagaaauagcagcacgugcugcuagguuaccgagggaaaaacgauggcguuuugaaccagaugcaauggcaagauuugauacagaagagaaauuuuuagcacgacaauuagucgacacucaguauuuaagucgccuggcaagagaauauuuaggcguauuauuucccgacaaaggagaggggucuggacgaguauggguuaguccaggaagacuuaccgagaugcuaagaagaucauggggauuaaaucauuuacugccggaucacaaucuaggaggaggagcagaucaaccuaaaaauagaagggaucaucgacaccacgccauugaugcaauaguuguugcaguaaccgauagacauuuacuacaagcuauagcgagagaagcaggacaaagaggacaugaggcagccaauaggaugacagcugaucuaccaguuccuuggccagacuuugauagagauguugggcaagucauaagacaggucgucguaagucaucgcgcugaccaugguacaguuucaaaggcaggagccgcgaaaggacaagacucaacggcuggcagacuacauaaugacacugcauacggccuaacaggacaaaccgaugaaaaaggcaauacgauagugguaaggagagucccguuaacugcauuaaagaaaccuacaaguaucgaggcuguacgagaugaugaauuacgaaaagcauuaagugucuggacuagaggauaugauggaaaagccuuugaagcaagauuaagcagauuuccggaacuaggaccauuacaguuuagaggaauaagaagaguuagagucgucgagccucuuaccguaauuccaauccgagauagcaguggucggguauacaaaggauauaaaggugacucaaauuacagguaugauguaugggaacuuaaagaugguaaauggguagcagaaguagugucaauguucgaugcucaucaaaguucuuggacaaguccgguaagaagagaaaauccuacugcgcgaaagguauuaagucuacaacaaaaugauauuguggcuauugaaccugaaggaaaagaaagagaauuaaugcgaguggcacaacuuagacaagguggucagauaaccuuagcagcgugucacgaagcaggggauuuaaagcgaagagaugcggaaaguaaugaagucgauccuuuuaaauauuuuaguccaacagcagggggucuaaagagagucagagcuagacaaguaagagucgacgaauuaggacgaguacuagauccuggaaguagagacagagagcguggggcagcguga

SEQ ID NO: 4916 - RNA, 3066 nt, Artificial Sequence
  Cas9 variant
augaaauauacccugggacuagaugucggaauagcaucaguaggaugggcagucauagauaaagacaacaacaaaauaauagaucuaggaguccgauguuuugacaaagcagaagagucuaaaacaggagaaucacuagcuaccgcuagacggaucgccagaggaaugagaaggagaaucagucgacgaucacaaagacuacgcuuagucaaaaaacuauuuguucaauacgaaauuaucaaagacucaagugaauuuaacagaauauuugacacuagccgagauggauggaaagacccaugggaacuaagauacaacgcgcuaucacgaauauuaaaacccuacgaauuaguacaaguucugacacauauuacaaaaagacgaggauucaaaagcaaccgcaaagaagaccuuagcacuacaaaagaggggguagugauaacgucaauaaaaaacaacucugaaaugcucagaacaaagaauuacagaacuauaggagaaaugauauucauggagacccccgaaaacaguaauaaaagaaauaaggucgacgaauauauacauaccauagcgagagaagaucucuuaaacgagaucaaauacauauucaguauccaacgaaaacuagguucaccguucguaaccgaaaaacuugaacaugauuucuuaaauauaugggaauuccagagaccauucgcaucaggagauagcauccuauccaaaguaggaaaauguaccuuauuaaaagaagaacuuagagcacccaccucaugcuauaccucagaauacuucggucuguuacaaucgauuaauaaucucguucuaguagaagauaauaauacacugacauuaaacaacgaccagagagcuaaaauuaucgaauaugcacauuuuaagaaugaaauaaaauacagugaaauaaggaaacucuuagacauagaaccagaaauacuauuuaaagcacacaacuuaacccacaaaaauccaucugggaauaacgaaucaaaaaaauucuacgaaaugaaaucauaccacaaacuuaaauccacauuacccacugacaucuggggaaaacuccacuccaacaaagaaagccuugacaacuuauucuauugucucacggucuacaaaaaugauaaugaaauaaaagauuaucuccaagcaaauaaccuugacuaucucauagaauauauugccaaacuaccuacauucaacaaauucaagcauuuaucauuaguagccaugaaaaggauaauaccauucauggaaaaaggauauaaauauagcgacgcuuguaacauggccgaacuagauuuuacaggaucuucaaaacuagaaaaaugcaacaaacuaacuguagaaccaaucauagaaaacguaacgaauccaguaguaauccgugcacugacacaagcaagaaaagucauaaaugcaauaauacaaaaauauggacuaccuuacauggucaauauagaacuagcaagagaagccggaaugacgcgccaagaucgcgacaauuuaaaaaaagagcacgaaaacaaccgaaaagcacgagagaaaauaucagaucuaauaagacagaauggacgcguagcaucaggacuagacauccuaaaauggagauuaugggaagaccaaggaggaagaugcgcuuauagcggaaaacccauaccaguuugugacuuacuuaacgacucauuaacucaaauagaccauauauacccuuacucaagaucaauggacgacagcuacaugaauaaaguauugguucuaaccgacgaaaaccaaaacaaacgaagcuacaccccauaugaagucuggggaucuacugaaaaaugggaagacuucgaggccagaauauacucaaugcaucucccgcaaagcaaggaaaaaagauuacuaaacagaaauuucaucacuaaagaccuggauucauuuauaucacgaaaccuaaaugauacacgcuacauaucaagauucuuaaaaaacuacaucgaaucauacuuacaauucagcaaugauucaccuaaaagcugcgucguaugcguuaacggccaauguaccgcucaauuaagauccagauggggacuaaauaaaaaccgggaagagagugacuuacaucacgcuuuagaugcagcaguaauagcgugcgcggacagaaaaauaaucaaagaaauaacaaauuauuauaacgaaagggaaaaccauaauuauaaaguaaaauauccucugccauggcacuccuucagacaagacuuaauggaaacucuagccggaguauuuauaucaagagcaccaagaagaaaaauaacgggaccggcacacgacgagacaauaagaucacccaaacacuucaacaaaggacuuaccucaguaaaaauaccuuuaaccacuguaaccuuagaaaaacuugaaacaaugguaaaaaacacaaaaggcggcaucuccgacaaagccguauacaauguauuaaaaaaccgacuaauagaacauaacaacaaaccccuaaaagccuucgccgagaaaaucuacaaaccacuuaaaaacggaacaaauggagccaucauaaggucgauacgaguagaaaccccauccuacacaggaguguucaggaaugaagguaaaggcauaucagauaauucacucaugguaagaguggauguuuuuaaaaaaaaagauaaauauuauuuaguaccaauauacguagcacacaugauaaaaaaagaauugccauccaaagcaauaguacccuuaaaacccgaaucacaaugggaacuaaucgacaguacacacgaauucuuauuuucccuuuaccaaaaugacuauuuaguaaucaaaacuaaaaagggaauaacagaaggauacuaccgaucaugccauagaggaacaggcagcuuaucacucaugccccauuucgcaaacaauaaaaacgugaaaauugacauaggcguucguacagcaauuucaauagaaaaauauaauguagauauacuuggaaacaaaucuauuguaaaaggagaaccucguagaggcauggaaaaauacaacaguuuuaaauccaacuga

SEQ ID NO: 4917 - RNA, 3072 nt, Artificial Sequence
  Cas9 variant
augaaaauccuuggauuugauauaggaguagcaagcauuggaugggcauuuguugaaggcgaugaaaucagagauugcggaguaagaauauucacgaaagcugaaaauccaaaaacaggugaaagucuagcucugcccagaagagaagcacgcggaguaagacgacggcucgcuaggaggagaguaaggcuuaacacuauuaagaaaauaauaugcaaagaauuugaccuaagauuauccgacuauauagcagacgacggcgaacuaccuaaggcuuaucaaaccaacaaagauacaaaaucaccauacgaacuaagauauaaagcacuaaacgaacgacuuucaaaagaagaauuagcaagaguaauacuccacauagccaaacaucgagguuacggcaacaaacacgcuaaagacggggaugauaaagauagcgguaaaguaaagaaagcaauaggagaaaauaaaacacuacuagaacaaaaaggguacgaaucaguaggcgaauauugcuucagagaguucuucaaaucaaucaaagacaaagauggggaaacacacaauauaccaagccagaacauacgaaacaagaaagguaacuacgauagauguguuucgcaaaaacaauuagaggaugaacuaaaauuaauuuucgcaaaacaacgaaaacucggguuuaauaaagaguucgaagaugcgauauuagaaguagcuuuuuaccaaagaccguuaaaagauuuugaugacaaaauaggagacuguauuuucuuugacaaugaaaaacgagcaccaaaagaauccauaucugcaauagaauuuguagcguuaacuagaauaauaaacacacuaaaauaccuaucaaaaacaacaggagaaguauaugaaaaagaaaucauuaacaaaaucuggcaaaagauacuagaaaacgggaaaaugacuuacgcggaauuaagaaaaauauuagcacuagauucaagcguguuuuucaaggauaaagaccucgacuacaccuuagguauuaaagaagcggagaaaauaaaauucauagaguucaagaaacuaauaaaauucaagaaagcacuagggucauucgauggauuauccagggaaauacucgacaacaucgcaaugcaaauagcaauaacaaaagacaggcaaagauuauuagaaaaacuugaaguguuuccacuaaauaaagaacagaaagaaaauuuaagucaacuaaauuuuaguaaauacauagaucuaagccuaaaagcccuaaaucagauacuuccauuuaugagagaaggucgaagauacgaugaagcaaaagaugaugcgaaauugcaagaaaaagcgaaaaauacuaagaaagaagaguuccuaccaccguuaaaagaauuugaucuaaacuuaacaaauccaguaguagcacgcgcacucgcagaauuuagaaaaguacuaaacgcccuacuuaagaaauauggcaaaguucauaaaauacauuuagaguucgcaagagacaugagacuagauuucgacgaacgagaaaggcucaucaguauacaaaacgacaacuucaauaaaagacaacuugccgaagauuuuuguaaagaacauggucuagaaccaucgaacgcaaauauucuaaaaauaaaauuguggcaagaacaacaauggcacugcauguacucaggcgaacucauagggauaccagacuuaaaagacccuacaaaacuacaaguugaucacauauauccauacucgagaucuuuugaugauaguuauacuaacaaaguacuugucagagcggaauggaaccaagaaaaaggcaaucauaccccuuucgaagcauucggcggcgauaaaaacaaaugggauaaaauuguagcacuagcugaaaaacuaccaccaucaaagaaacuaaauagaucagaaaaaucaaagaaagauaaacuacuagacgaaaaauuuaacgacaaagaacucggauuuuuagcacgaaauauaguagacacagguuacauagcaagacuuguagcgaaauauaucgauauguaccuugaguucuuaccacuugaagaaaaugaaaauaccucuuuagcccgaggagaaaaaggcaguaagaaacauauaggaauaguaaacggaagacuuacaucagaaguaagacauaacuggggccuugauccuaaagaucgcgauaaucaccuacaccaugcuauugaugccauaguaauugcauacaugaacgauaaacgaauaaaagcauuugcagauuucagaagauuaaaggaacuaaaaauaaaacgauacggacgggaaauaacagaagaugaauaccaagaaaagaagaaagaacuaucaugcgcaccauucgacgacuucagaaaccgaacccucgaaaacauugacaaaauauuuguaagcagaccaccccgaaaacgugcacgaggcacauuacaugaagaaaccuuuuauucuauagaugauaagaaacuguuaaaagcauauggaggaaaagaaggcaugcaacgagcacucagucuggggaaaauaagacaaaucgguacaaaaaucguuaaaaaugggacaaugguaaggguagacauauucaaagacaaacgaggacgauucuaugggguaccgauauauacaauggacuuugcguuaggaguauugccuaauaaagcagcugucaguggaaaagacaaaaacggauuaauaaaagaaugggccgaaauggacucaggauacgaguucugcuucagccuauuuaaagaugacuugauucuaguccaaagaaaagaaaugcaagaaccagaauuauguuauuucguuagcuucgauaguucaaaugcacagauagacguaagaagucacaauaaccacuucaguguacucaacgaaaaucaaaaacuccucuuuaaauccgcaacacaagcagaaguaauaggagaauccauaggaauccaaaaccuaaaaguauuugaaaaauggcauguaucaccguuaggagaaguacgaaaagcagaauuuaguccacgaggugaagcuaaacugaaaacuagcaagaaacgaaagaaauga

SEQ ID NO: 4918 - RNA, 3072 nt, Artificial Sequence
  Cas9 variant
augaaaaucuacucauuugauauaggaguagccucgauaggaugggcuuucauagaaaacgaaguccuacaggauugcggaauucguauauuuacaaaagccgagaauccaaaaaacggugcgucuuuagcauuacccagaagagaagccagaggaguacgaaaaagauuagcacgaagaagagguagacuuaacacaauuaaacaacuguuauguaaagaauuuggauuacaacucgaggauuaccucucaaacgauggugaacuaccaaaagcauacacagcuucgaaagccaaucccuuaaaaucaccauacgaacuucgaacauuagcuuuaucucaaaaauuagacuccaaagaccucguuagaguaauacuacacaucgcaaaacauaggggauacggaaacaaacacgcuaaagauuccaaggauaccgagucgggaaaaguaaaaaaggcaauagaauucaaucgaaaaacacuagcagaaaaaggauauaggucagucggggaauacuuguaccgagaauucuuucaacaaagcagaaucagccaaaacaacggcgcaacagaauuuauuaacguaagaaauaaagccggaaacuacgagcauugcguugcccaagacaugcuaaaagaagaauuagagucuauccuuaacgcccaaagacaauucggcuuuucacuaaaacaagacuucgaaucaaaauuauuaacuaagauauuugaacagcgaccucuaaaaagcuucgcagacaaggucggcaauugcugcuuuauagcaggcgaaaaacgugccccaaaagacucaccaucagcuauagaauucaucgcauuaucuagaacaauaaacacucugauaaacuuaagcaaagaaagcggugaaauauauaaccgagcuaucauacuccaaaucguagaaagcacacuaaaaaaaggcgagauaucauauaaagaacuuagagaaauaauaagacuagaugaaagguuacguuucaaagacccacgcuuagacuacucaagagaaauaaaagaggcagagaaaguuaaauuccuggaauuuaaacaauuaaaagguuucaaaaaggcauuaggcgaaucguuuacaacacuagcaauuucacaauuagaugagauugcagaacauauagcccuaauaaaagacagagucaaauugaaugaaaagcuagaaucauacgcccucacaaaagagcaaagagaggcauuaucaaauuuaagcuucucagcacacauaaaucuuucacuucaagcauuaaaacaaauacuaccauucaugcguggcgacaauggagaacaauguuuagacuaugacgaauccguggaaaaagccggauuaaaagcacucucuaaggauacacuaaaaggccaaaugcugccgccacuaaaugaauucgaacccuaucuaucuaacccgguaguagcaagagcauuagcugaauacagaaaaguauuaaauguauuacuuaaacaauacgguucaccccauaaaauucacauagaauaugcuagagaagcaaaacuaagcucaacugaaagacaaaaauaugaaaaagaacaaaaagauaauuaugcugcuaaccaggcagcacauaaaaaaugucaagaauuaggcuuagaaccuucuagcacaaauuuauuaaaacuaaaauuauggcaagaacagggaggacugugccuauauucaggagcaaaaauaacgauaucauaccuccaagauccaacagcacugcaaguagaccauaucuacccuuauucccgcucauuugacgacagcuauaugaacaaauguuugguacuaaccaaagcuaaccaggaaaaaggaaaucggacuccauuugaagccuucggaacagacagugcaaaaugggguguaauaaccacauuagcccaaaaacuaccgcauaaaaaaagaagaagaauauuaaauacagcauucaaugacaaagaagcaggauuuaaacuuagaaacuuaaacgauacaagcuacauagcgagacuuguagcugacuacaccgaaacguaccuggaauuucuaccucuuguagaaucagagaacacaacuuugucaaaaggccaaaaagguucaaaaaaacacauagcaauaguaaacggaguacuaacaaguacuaugagguacuaccuaggcuucgcgaguaaggacagagauaaccaccuacaccaugcccuugaugccguuaucauuggauucaugaaugauagcgucauaaaagccuuuagcgacuucaaaaaaacacaagagacaagcaaagcugccuauuacgcacauacccuaucuaaacaagaauacaaaaaacaaagagcauucauacaacuacccaguggagaaaacuuccgaguaucaguauuagaaaaagucgaaaguguauucguaucaaaaccucccagaaaaaggguacgaggagcccuacacgaagccacuuuuuauucaccaaacgaucccaaacuccuaaaaaacuacggagguaccaaaggaguagaacgagcuuuagcuuuagggaaaaugagaaaaguuggcgcaaaaauaguaucaaauggagcaaugguaagaguagauauuuucagacacaaaagcaguggaaaauuuuauggcguaccaguguacacuauggacuuugcacucggcauauuaccaaacaaagccgucgucguaggcaaagaccaaaauggggucauaaaagacuggcuagaaauggacaguucauacgaauuuauuuucucacuauacaaagacgacguaauacuaguccaaaaaaaagaaaugcaacggccagaauuauguuacuucguaucuuuugacacaucaggugccucaauaaaaguagcaaaacaugauaauaauuucucuaccuuaacagaaaaucaaaaauuacuauuuaguaaugcuacaaaagaagagguaguagguaaaagcauaggcauucaaaaccuaaaaguguucgaaaaauggcaaguaagcguauuaggagaaguuaaaagaacacaaaguuauccgagagaaaauaucagcuuagcaagcaaagcuaaaaaauga

SEQ ID NO: 4919 - RNA, 3075 nt, Artificial Sequence
  Cas9 variant
augauaaggacacugggaauagauaucggaauagcaucaauaggaugggcaguaauagaaggagaauauacagauaaaggauuagaaaauaaagaaauaguagcaucugggguaagagucuuuacaaaagccgaaaaccccaaaaacaaagaaucauuagcucuaccgagaacauuagccagaucagcccguagaagaaacgcaagaaaaaaaggcagaauccaacaaguaaaacacuaccuaaguaaagcauuaggacuagaccuagaauguuucguucaaggggaaaaacuagcaacacuauuucagaccuccaaagacuuccucaguccaugggaauuaagagaaagggcacuauaccguguucucgauaaggaagaacuagcaaggguuauccuacauauagcuaaacgaagagguuaugaugauauaacuuacggaguagaagauaacgauucagguaagauaaaaaaggcaaucgccgaaaacagcaaaagaauaaaagaagagcaaugcaaaaccauuggagaaaugauguacaaauuauauuuccaaaagagcuuaaacgucaggaacaaaaaagaaaguuauaaucgaugcguaggaagaagcgaacuaagagaggaauuaaaaaccauuuuccaaauacaacaagaacuaaaaucaccaugggucaacgaagaauuaauauauaaacuauuagguaauccagaugcacaaaguaaacaagagagagaaggauuaauauuuuaucagagaccucuaaaaggauucggagacaaaauuggaaaaugcucacauauaaaaaaaggagagaacucaccuuaccgggcauguaaacaugcuccaucagcugaagaauucgucgcacuaacaaaauccauaaauuuccuaaaaaauuuaacaaacagacacgggcuaugcuuuagccaagaagauaugugugucuaccuaggaaaaauacuccaagaagcucaaaaaaaugaaaaaggacucacuuauagcaaacuuaaacuauuacucgauuuaccgagcgacuucgaauucuuagguuuagauuauucagguaaaaauccagaaaaagccguuuucuuaagucuacccaguacauucaaauuaaacaaaauaacacaagacagaaagacacaagauaaaaucgcaaauauacuaggagcuaacaaagacugggaagcaauauuaaaagaauuagagucacuacaacuaucaaaagaacaaauacagacaauaaaagaugcaaaacuaaauuuuucuaaacauaucaaucucagcuuagaagcuuuauaccacuuacugccccugaugagagaagguaaaagauaugacgaaggaguagaaauacuacaagaaagaggcaucuucagcaaaccucaaccaaaaaaccgacaacuacuaccucccuuaagcgaacuagcaaaagaagagucauacuuugacaucccaaaccccguccuaagacgagcuuuaagugaauuuagaaaagucguuaacgcccuacuggagaaauacggcggauuccauuacuuucauauagaauuaacaagggacgugugcaaagcuaaaagugccaggaugcaacucgaaaaaauaaacaaaaaaaacaaauccgagaaugacgcggcaucacaacuccuagagguacuaggauuacccaauacauacaauaaccgacucaaaugcaaacuauggaaacaacaagaagaauauuguuuauacaguggcgaaaaaauuacaauagaccacuugaaagaucaacgagcucuacaaaucgaccaugcauuuccacuuucaagaagucuggaugauucacaauccaacaaaguucuaugccuaacgucauccaaucaagaaaaaaguaacaaaacucccuacgaauggcuaggauccgacgagaaaaaaugggacauguacguaggaaggguauacagcucaaacuuuagucccagcaaaaaacguaaauuaacacaaaaaaacuucaaagaacgaaacgaagaagacuucuuagcaagaaaccuaguagacacagguuacauuggaagagucacaaaagaauauaucaaacauucccuaucauucuuaccucuacccgaugguaaaaaagaacacauuagaauaaucucaggauccaugacaaguacaaugcguagcuucugggggguacaagaaaaaaacagagaucaccaccuacaucacgcacaggacgcgauaauuauagcauguauagaacccagcaugauacaaaaauacacaacauaucuaaaagacaaggaaacacauagacuaaaaagucaccaaaaagcacaaauccuucgagaaggugaccauaaauuaagccuacgcuggcccaugagcaauuucaaagauaaaauucaagaaucaauacaaaacauaauaccaagucaccacguaucccacaaagucaccggagaauuacaccaagaaacaguaagaaccaaagaauucuacuaucaagcguucggaggagaagaaggaguuaaaaaagcauuaaaauucggaaaaauucgagagauaaaccaaggaaucguagacaacggugcaaugguuagaguagauaucuucaaaucaaaagacaaagguaaguuuuacgcuguucccauuuauacauacgauuucgcaauaggaaaauuacccaacaaagcaauuguccaaggaaaaaaaaaugguauaauaaaggacugguuagaaauggacgagaacuacgaauucuguuucagccucuucaaaaacgauuguauaaaaauacaaacaaaagaaaugcaagaggcugucuuagcuaucuacaaaucuacaaacucugccaaagcaacaaucgaacuagaacaccuaagcaaauacgcuuuaaaaaacgaagacgaagaaaaaauguucacagauacagacaaggaaaaaaauaaaacaaugacaagagaaaguugcggaauacaaggauugaaaguauuucaaaagguuaaauuaagcguccugggugagguauuagaacacaaaccucguaacagacaaaacauagcuuuaaaaacgacaccuaagcacguuuga

SEQ ID NO: 4920 - RNA, 3078 nt, Artificial Sequence
  Cas9 variant
augggaggauauaugccacaauuaaugcgauaucgccuagcauuagacauuggaucaacaucaauuggaugggcaaugauaagauuaucaaugcaaaaugagccaauagcuauaauaagaaugggcguuaggauauucucagauggaagaaaccccaaagauggaucaaguuuagcuguaacccgaagaguugccagacaaaugcguagacgaagagauagauuacuaaaaagaaaaacacguuuacuaaaugcacugguacaaaagaaauuuuucccugaagaugcagaugccagaaaggcuuuaguaguuuugaaucccuaugaauuacgaaaagaaggccuauauaggcaacuaucaggcccagaguuuggcagagcacucuuucauauaucccaaagaagggguuuucuauccaacagaaaaacagacaagaaagacaacgacagcucagucuuaaagaaagcuauaguugaccucagacaacaacucgaaguagagaauugucaaacuauaggggaaugguuguuuaaacaacaacaaaguggcaaaucagucagagcaaggcuuagaggaaaaacgcagaaagacaaagcauaugacuuuuauauagauagagcaaugauagcacacgaauuugacacuuuauggguaucacaagcuaaauaugauccuuuacuguuuaacgaagaugccagagcaauacuaagagacauucuacuauaccaaagaccgcuaaaaccagugaaacccgguagguguacucuaauaccagacgaaucucgugcuccauuagcacuacccuuaacacaacaagcaagaauauaccaagaacuaaaucaucuucgcauuaccacaccagcgcuaggagcacaggcuuuaacaguugcacaaagaaauacgauagcagcccuucuggaaaagagcgacguaacauuuguaaaaauagccaaagcacucggacuuacaaguacaacggaguucaauuuacaagacauuaaaagagauagguuaaaagguaacgcuacagcaauuaucuuagcuagaaaccaauacuucggacgacgauggcaugauuucaaugcugaucuacaaaaccuaauuguagauaaauuaguuaaugaaggcucagaaacagcauuaauagaaugguuaaaagcaaauacagacguugacgaaucagcagcugaaaggguaucagguguuacacucccagaagguuauggguccuuaaguguagcagccuuaagaagauuauuaccagcauuaaaagaggacguaguaguauacagcgaagcagucaaaagagcaggauuugauucacacucugcuuuaaguuuaauugaacaaacaggagaguuauaucaagaacuaccuuacuauggagaaguacuacaaagacauguaggguucggaucaggugauccaaaugauaguccagaacgucgauuuggaaaaauugccaauccaacaguacauauaggguuaaaugaacuaagaaaaauaauuaaugcguuaauaaaaagauauggaaauccagcagagguaguuguagaguuagcaagggauuuaaaacuaagucgagagaaaagaaaagaaauacaagaagaacaaaaacaacgacaagaucgaaacgaaaagagaauaaaagaugcuugcgaaauucuagguauagauccucuagugauugaccguggcaaaagaagagaaauuucucagaaaaugcaacuaugggaugaauuaaacccaaaagacgcagcaaauagacguugcccauauacaggggaucaaauauccauagaaaaauuacuuagugcagaagucgaaauagaacacauauuaccauucuccaaaacacuugaugacaguuuaaauaauaaaacuguagcaaugaggagagcaaauagagacaaaggaaaucgaacaccauaugaagcauucggagaaagucuuaacccagauuaugauuaugacgcaauccuacaacgagcaucucuuaugcccagagaaaaacgaaaaagauucgcuagcgaugguuaccaacaaugguuacgagaugauaaagacuuucuaagcagagcuuuaaaugacacggcguaucugucgcggauagcaaaagaauauuuaacauuaauaugcccuccuaauucaguacgagccauuccaggacgaaugacugcacaauuacgagcuauguuuggucuaaauagauuauuauccgaaggcggaaucaaaaauagagaagaucacagacaucacgcaauagaugcagcgguaauaggaguaaccgaucaaggacuauuacaaaaauuuuccagagcaucagcacgaacacgugaauuacaauuaaguagacuuguugaugacaugccuuuaccaugggacacauacagagaacacgucacaagagcauuagagcauuuaguagucagucacaaaccagaucacggauaucaaggcaaaaugcaugaagauacugcuuggggauuaagggacaacggacaaguaacaagacguguucgcucagaagauggaggaccaagacaacgucuccuagaaaauaaaaacgucguuaagauaaauucaacacgcgacuuuaguagacauggaauagaugaacaaggccaaguuaacgcauauaagggguacguuggaggaaguaacuacugcauagaaaucuggauagaugaaaaaggaaaauggaacucagacguaguaucaacuuuucaagcauaucagauagucagagaauuaggugaaaaggccgcauggcaaaaauuacguaauccauuauuaucccugagugcaaaaccacucguuaugagauuaaucauagaugauguagugaaaaugcaaauagcuggacaaaauaaaauaaugagaguugugaaaauagcccaaaauggacaaauauuuuucgcggaacauaaugaagcuaacguagaugcucgagauaaggacaaaaacaauccauucaaauauauaucaaaaacggcggguucgcuccaaaaagcaggcggaauacauauggcaauaucgcccaucggugacgcaagaccgguacgauauggaagauga

SEQ ID NO: 4921 - RNA, 3084 nt, Artificial Sequence
  Cas9 variant
augaaauauacauuaggacuagacguaggcacuaauucaauaggcugggccguauuagaacuaaacacuaacggagaaccacaaagaauagaaaaauuaggaaguagaauauucacugacggaagacacccaaaagauggaaccacacuagcuagcaaacgaaggcaaaaacgccacgaacgcagaagaagggacagauugcaucaaagaaagaagcuaguacucaaucaauuaguaagcaugggucuauucccacaaucagaacaagaacaacaagaucuaaaaagccuagacguacuaacauuacgagcgaacggcguuucaaaacaacuaucugcuuaugaacuaggaaggguauucuacuauuuaaacuuaaaaagaggauucaaaaguaacaggaaaggcggaucagaagaagacaaagcuaacaaaauauccgaaagaauuaagaaacuacaagaacaacuaaaagaaaaugauuucaaaacaguaggccaauauuuacacgaccgguauauaaaaggacuauccacaaaagcaacaauagaaaacgacuuucaccuauuaagacaacuuauagaagacgaguucgauuucauaguagaaacccaaucaaaauucuuccccgaaaucuccgaugaacaauggaauacacuccggaacagaauguuccaucaaagacccuuaaaaccaguggaaacaggcacauguagucuauucgaagacaagaaacgaacauacaaauacaugccaaguuuugaagaauauagauuccuaacugaacucuucaaccuguccuaucaagacgaaaacuuucacucacauucacuaucgucagaacaaauuuucaaagucuuccacgaacuuaaaaacacacgagaagcaacauauacuaaaauaaagaaauuauuaaaacuccccagcgacuuaaguuucucuauagaaagaucaaaaucaaaagauaaaauaaaaaucucaacuacaaaccacuucuucuccaaaucauuacuauucgcagaagaaugggccagccuagaucuaaaacuaaaagacgaaguagcugaaauauauuucuccgacaugucgguagaagagauuaagaaaggauuacuccaacuaaaaaucgauuccgaaaucauagaaaaccuccuagaagaaaaagucccaaacguacaagaagcgaccugcagcuacucaaaagaagcacuacagaaaauaguaucauuaauccucgaagaagaacgucaccccacacuaauagucgacgaccuauucaaaaacgaaaaagaagaaacgucacucauagaccgacuagacuacuacggagcaucaauuccagacucaaugcaaccuauaccacaacauaucaaagacaauaacuuaacauuaaaugaagaugaaaaacgcuacgggaaaaucgcuaaccccacaguacaugccgcucuaaaucaaauucggcaagucguaaaugaccucauagaacaauacggaaaaccaacaaacauacacaucgaguucgcaagagauuugaaaaagucuaaagaagaacgagacuucgauaaccgaaagaaaaagaaaaacgaagaacuaaacgaacaaguaagagacuucauagaaaaacacaaucaaaaaccuucugccuuuaauuucgaacgaguuaagcuaugguucgaacuagacgcaaugaauaaucaaguaugcgcauacucaggaaaaacaaucucugcacgcaugguacucucagacgaaguccaaguagaccacaucuuaccauuuagcagaacauuagacgauuccuuagcgaauaagguguuaguauuagcuucggaaaauguaaagaaacguaauagaaccccauacgaagccuucggucaagauacagaaaaaugggcaucaauucaagaauuagccaaaagacuaccauaucacaaacaauggagauuugcagaagacgcuauuaagaaauuugaagaaaaagaucaauuccuacaaagacaucucaaugauacaagauauauauccaaaauagcaaagaaauauuuaggcucuaucaccgauccauauaaaauagucgcaucacgaggccaaaugacauccauaauaagggguaaauuaggacuaaaucaauuuauccaaaaacccgauggaaccaaaaauagagaagaucauagacaucaugcuaucgacgccuuaacaguagcgcuaacaucccgaaguuaccuaaaacgaaucagugacgcaucagcaagaaaucaagaccccaacagaauacccauacccgaaccauggaaaggcuuuauaaaagacgcagacgucaaauucaaugaaauaauaguuucccacaaagucgaccaugguaaaaacggaccauucauggaagaaacauguuuugguuugaucaaaaaccccaauaaauaugaagaagaaaacgacuucaaacuaaucacaacaaaaucauuagacuccgucaaagacccaucuacgauuagaagucagagcuugcaaaacuuagcagaaaaaucuggaguaaucuccuuggccaaaucagggguaaagaaacuacgugucuaugacguaaccaaagaaaauccugcugacaucgguuuaauagaaaguggacuggccaaaauaacucacggaaaagauaaacaacacguuaaacauuaccaaaaaggagacauaaauuacuuagcaaucuggugucuaccgcaaaauauaaccuuaaaaucagacaaccacaagaaacgcaaaacagauuauauauuuacagcaauaaagacauuugaccuaaacaguaaaaauccaaaugaucuaagaccccauccugcagcaaaauuaguaacaaaagucuauaaaggcgacacaguagcuuuagaaguaaauaaccaauuaaacuacuacauuguaaaaucaauacgagcagcaaauaaaaagcuauauuuccuaaaaaucaaucaaucuuccgaauuagccaacgaaacacaauucauacccgcauacaccaagcuaguagacuauaaauuccgaaaagucucaguaucaccuaccggcguaauaacagauaauggaccacuacuaaaauga

SEQ ID NO: 4922 - RNA, 3090 nt, Artificial Sequence
  Cas9 variant
augaggagccuuagauauagauuagcauuagacuugggaucaacgagucuaggaugggcacuguuccguuuagaugcauguaauagaccaacagcaguaauaaaagcuggagugagaauauuuucagauggaaggaauccgaaggaugguuccagccuagccguuacaaggagagcggcuagagcaaugagaagaaggagggacaggcuauuaaaaagaaaaacaagaaugcaagcaaaguugguggaacacggcuucuuuccggcagacgcaggaaaacgaaaagcucuagaacaacuuaauccuuacgcauuaagagcaaaagggcuccaagaagcauuauugccaggcgaauuugcacgagcauuauuucacauuaaccaaagacgaggauucaaaaguaauaggaaaacggauaagaaagacaacgacucagguguauuaaagaaagcuauuggacaacugagacagcaaauggcugagcaaggaaguagaacagugggagaauacuuauggacacgauuacaacaaggucaaggcguaagagcaagguaccgugagaaaccauauacuacugaagaaggaaagaaaagaauagauaaaucuuaugaucuauauauugauagagcaaugauugagcaggaguucgacgcuuuaugggcagcacaagcugcuuuuaacccuaccuuauuccaugaagcugcucgagcagauuuaaaagauacacucuuacaccaaaggcccuuaagaccaguaaaaccaggccgauguacucuuuugcccgaagaagaaagggcacccuuagcacuucccagcacccaaagauuccgcauucaucaagaaguaaaucauuuaagauuauuagaugaaaaucuaagagaaguugcccuaacacuggcccaacgagaugcaguaguaacagcucuagaaaccaaagcuaaauuaaguuucgaacaaauuagaaaacuacuaaaacuuucaggcucuguacaguucaauuuagaagacgcaaaacgaacggaacuaaaaggcaacgcaacaucagccgcauuggcaagaaaagaacuauuuggugcagcguggucaggauuugaugaagcgcuacaagacgaaauaguauggcaacuuguaacagaagaaggagaaggagcauugauagcaugguuacagacacacacugguguagacgaagcaagagcacaagcgaucguugaugucagccuuccagaaggauacgguaaucuaucucggaaagcauuagcgagaauaguaccagcuuuaagagcagccguaaucacauaugauaaagcuguacaggcugcaggauucgaccaccauucacaacuuggcuucgaguacgacgcauccgaaguagaagacuuaguucacccagaaacaggggagauuagaucuguauuuaaacaacucccauacuaugguaaagcacuacaaagacauguagcuuuuggaagugggaaaccagaggauccggaugagaaaagauacgggaagauagcaaauccaaccguucauauaggauuaaaucaaguacgaauggugguaaaugcguuaauacggagauacggaagaccuacagaagucguaauagaauuagcaagggaccuuaagcaaagcagagaacaaaaggucgaagcucaaagaagacaggcagauaaucaaagaagaaaugcaagaauacgacgaagcauagcagaaguauuaggcauaggcgaagaaaggguaagagguucugauauucaaaaauggauauguugggaagaauuaaguuucgacgcagcagaucgaagauguccguauaguggaguacaaauaucagcagcaauguuguuaucagaugaaguagaaguagaacauauacuaccguuuucaaaaacccuugacgauagccuaaauaauagaacaguagcaaugcgacaagcaaacagaauuaaaagaaacagaaccccaugggaugcacgcgcugaauuugaagcucaaggcuggucauacgaagauauauuacaacgggcagaaaggaugccccuaagaaaaagauacagauucgcaccggauggauaugaaagaugguuaggagacgacaaagauuuucucgcccgagcucuaaacgauacuagauaucuaucuagaguugcagcagaauaucuaagauuaguauguccugguacccguguuaucccagggcaacuaacggcauugcuaagaggaaaauuuggguuaaaugauguauuaggauuagauggagagaaaaaucguaacgaucauagacaccaugcaguagaugcaugugucauagguguaacagaucaaggacuuaugcaaagauucgcaacugccucagcacaggcaagaggugauggguuaaccagauuagucgacggaaugccaaugccuuggccaaccuauagagaucauguugaaagagcagucagacauaucuggguuucacauagaccagaccacggauucgaaggggcaaugauggaagaaacuucauauggaauacgaaaggauggauccauuaaacaaagaagaaaagcagauggaucagcaggucgugaaauaaguaauuuaauacgaauacacgaagcaacccagccauuacgacauggaguauccgcagauggccaaccauuagcauacaaaggauauguaggagggaguaauuacugcauugaaauuacagucaaugauaaaggaaaaugggaaggagaaguaauaucaacuuuuagggcauauggaguaguaagggcgggaggaaugggacggcuacgaaacccccaugaaggucaaaauggaagaaaguuaauaaugagauugguaaucggggauucuguacgcuuagaaguugauggagcagaacguacaaugagaauuguuaaaaucucagggucaaauggucagauauuuauggccccaauucacgaagcaaauguagaugcuagaaauaccgacaaacaagacgcuuucacauauacaaguaaauacgcugggagcuuacagaaagcaaagacuaggagagugacaaucucgccgauaggcgaagucagagaucccggcuucaaagguuga

SEQ ID NO: 4923 - RNA, 3090 nt, Artificial Sequence
  Cas9 variant
augaaauaccgacuugccuuagauuuaggaaguacgucacuaggaugggcuauaguccaacucaaugccaaagaugaaccuugugcgauuguacgagcuggaguuagaauuuuuccugauggaagaaacccaaaagaugguuccaguuuggcagucacacgaagaaaugcaagggcuaugcgaagaaggcgagacagacuucugaaaagaaaagcaagaaugcaaagacuauugauagaacaugaucucuuuccagcagaugaagcagcaagaaaggcguuagagacccugaauccauaugagcuaagagcuaaaggauuagaugcagcacuuacaccagcugaauuugcuagagcucuauuucauuuaaaucaaaggagaggauucaaaaguaacagacgcaccgauagaaaagacaaugacucuggagccuuaaaagcggccauagggggucuacgagcucaacuagauacagcgggagcggacggcagagcaagaaccguaggugaacuauuauggagaagaaugagcgauccaaaugucuuaacgguccgagcaagauauagggaacaaagaauaaccaaagaugacggaaagacaagaguggacaaaucauacgauuuauauguagauagggcuauggucgaagcagaauuugaugcauuaugggcaaaacaagcagaacuaagcccuacacaauuuggggaagcagcucgagcaaccuuaaaagacuguuuauuacaucaacguaauuuaagaccgguuagaccaggaagguguacguuagaaccagacgaaccacgggcuccuuuagcauuaccaucccaacaaagauuuagaauacuucaagaaguaaaucaucuaagauuauuaggaggcagacuacuagaagagaguuuaucaguagagcaaagagacaaauuaguagcugcuuuggaagauggcucaaaaucauuuaaaacggccauaccaaaauuacuuggauuaccggggacaguccaauuuaaucuagcagacgcaaaaagaacagaacuuaaggguaaugcaacgaguaugcuacucggcaagaaagacuuuuucgguccagcguggcauggauuuagcgaagcacgacaagaugaaauugugaugagaauacaagaagaagaaucggaagccagacucguagauuggcuagcaacaucaaccggagucgaugaagcucaugcgcuuaaaauagcuaaugcagcgcuaccagaaggguauggaagccuaagugcaaaagcacuggcaaagaucuuaccagcgaugagagcagaaguaaucacguacgauaaagcuguuuuagcagcaggauaugaucaucauucacacauaagccaugcagcuucaacgggugaaauauuaccagaauuaccauacuauggagaauacuuacagagacacguaggauucggaacuggggaauuaaacgauaccccugaaaagagguuuggacggaucgcaaauccaacaguccauauaggacuuaaucaaguuagaguaguaguuaaugcauugauaaaaagauauggacauccaacagaggucauaguagaaguugcaagagaccuuaaacaaagccaagaucaaaggagagagacacaagaacaacaagcuaaaaaucagaaaagaaaugaaagauuaagaaaagaugcagcugcgauacuaggaauagcagacgagagaguacgauuagccgacauacaaaaauuaauauuaugggaagaauugaguuuugacauagcagaccguagauguccauauaguggaguucaacuaagcgcagccaugguauuaucagaacaaguagaaauagaacacauuuugccuuuuagcaugacuuuggaugauagcuugaacaacaaaaccgucgcuaugagguuagugaacagauuaaaggggaauagaacaccaugggaugcuagggaagcauuugccggccaaggaugggauuaugacgggauauuaaugagagcggaacguaugccacgagcgaaaagacaaagauuugcaccugacgggcuugaaaaaugguugaaagaagacaaagauuucuuggccagggcauuaaaugacacuagacaccuaagcagaguagcgagggaauaucucagccugguuuguccugcaucgacaagaguaauacccggacaaaugacagcaaugcuaagagcuaaauucggucuaaaugacauacuaggacuuaauggcgaaaagaacagaaaugaucauagacaucaugcaguagaugcauguguaguagcgguuacggaccagggauuauuacagagguuugcccaagccucagcagacgcacgaggcaaagguuuagaucgucucguagaaaccaugccagauccaugggacagcuauagagaacacgugcaacgagcuguuaauagcauauggguuagccacaagccggaccauggauuugaaggagcuaugcacgaagauacaacauaucguccaccacacuuagacccgaaaaacauguggagaacgagagggauaggagguggaaaaccaaacgaaaaagaagccgacagcaaggcaaugguaggauuuacaggaccugaacaucuacagagacaucauagagauaaagccggucaacaacugccauauaaaggcuauguagcaucacccaaauuuuguauggauauaguucggaaugacaaaggaagaugggaaggagaaguugugucaacauuugaagcguauagguuaguaagugaauuuggacgagaugcagcucuagcccauauacaaucaaaaaguagaagcauaucaggcaagccacucguaaugagacugcaaggaggagauaugguacgauuugaugacgaugaagggcgaccaguaguucuuaggguugucaauaugacugguaauggacaaauauucuuugcuccacauaaugaagcaaacggagaugcgagaaaccgagauaaacaagaucaauuuguuuauuuaucaaaauacgcagggagcuuacagaaagcaagaggccgcagaguaaccgucagcccagcaggagaauuaagagacccuggauuuaaagaauga

SEQ ID NO: 4924 - RNA, 3090 nt, Artificial Sequence
  Cas9 variant
augcgaaguuuacguuacagauuagcacuugauuuaggaagcacaagucuagguugggcacuauucagacuggaugcuuguaacagaccuacagcagugauaaaggcaggaguacgaaucuucagugauggaaggaauccaaaagaugguucauccuuagcaguaacaaggcgugcugccagagcaaugcgaagaagaagagauagguuauuaaaaagaaaaacaagaaugcaagcuaaacuggucgaacaugguuucuuuccugccgaugcaggaaaaagaaaagcacuagaacaauuaaauccauacgcccuaagagcgaaaggauuacaagaagcccuucuacccggagaauuugcaagagcucuguuccacauaaaucaaagacguggauuuaagaguaauagaaagaccgauaaaaaggauaaugacucaggugcauuaaagaaagcaauaggacaacuaaggcaacaaauggcagaacaaggaucaagaacaguaggagaauaucuuuggacaagguuacaacaaggucaaggaguaagagcucgauauagagagaaacccuauacaaccgaagaagguaagaaaaggauagauaaaaguuaugacuuauacaucgacagagcuaugauugaacaagaauuugacgcccuaugggcggcccaagcagcauuuaacccuacguuauuucacgaagccgcacgggcggauuuaaaagauacccuacuccaccaaaggccauugagaccaguaaaaccaggacgauguacuuuacuaccugaagaggaacgagccccauuagcauuaccaucuacacagagauucaggauacaucaagaagucaaucaucuacgauuacuugaugaaaaucuaagggaaguagcgcuuacacuugcucaaagagaugcgguaguaacagcguuagagacaaaagcgaaauuaucauuugaacaaauacguaaauuauuaaaauuaucaggaucgguacaguuuaauuuagaggaugccaaaagaacagaguuaaaagguaaugcuaccagugcugccuuagcaaggaaagaauuguuuggugcggcuuggucuggauuugaugaggcuuugcaagacgaaauuguuuggcaauuaguaacugaagaaggggaaggcgcgcuaauugcaugguuacaaacccauacagguguagaugaggcacgagcacaggcaauaguagauguaucgcuuccugaaggauacgguaaucuaucaaggaaagcauuagccagaauaguaccugcacuacgagcagcaguaauaacauaugauaaagcagugcaagcagcugguuuugaucaucacucacaauugggcuucgaauacgacgcaucagagguagaagaccuaguacauccagaaacaggugaaauaagaucaguauuuaaacaacuuccauauuacggaaaagcccuucaaaggcacguugcuuuuggcucagguaaaccagaagacccagacgagaaaagauauggaaagauagcaaauccuacagugcauauagguuuaaaccaaguaaggauggucgucaaugcacugauuaggagauauggaagaccaacugaaguaguaauagaacucgcacgagauuuaaaacaaaguagggaacaaaaaguagaggcacaaaggcgacaagcugauaaucaaaggagaaaugcacgcauaagaagaucuauagcagaaguauugggaauaggagaagaaagagugcgaggaagugacauacaaaaauggauuugcugggaagaacucagcuuugacgcagcugauaggcgauguccauacuccggggugcaaauaagugcugcaauguuauuaucagaugaaguagaaguggaacauauacuaccauucagcaaaacauuggaugauaguuuaaauaaucgaacgguagcuaugaggcaagcaaacagaauaaagcgaaaucgaacgccaugggaugcgcgagcggaauuugaagcacaaggauggucguacgaagauauauuacaaagagccgaacgaaugccccucaggaaacgauaucgauucgcaccggaugguuaugaaagaugguugggugacgauaaagacuuucuagccagagcuuuaaaugacacuagguacuuaucaagaguagcagcggaauacuuacgauuaguaugcccagguacgaggguaauacccggacaguuaacggcauugcucaggggaaaguuuggcuuaaacgauguauuaggcuuagacggggagaaaaauagaaaugaccaucgacaccacgcaguagacgcuuguguuauugguguaacagaucaagguuuaaugcaaagguuugcuacagcaagugcucaagcacgaggagauggucuaacuagauugguagauggaaugccuaugccuuggccgacuuacagagaccauguagaaagggcuguacgucauauauggguaagucaucgaccagaccauggauucgaaggagcuaugauggaagaaaccucauauggaauaagaaaagauggauccauuaaacaaagaagaaaagcagauggcucagcuggcagggaaauaaguaaucuaauaaggauucaugaagcaacacaaccacuaagacauggugucucugcugauggacaaccauuagcauauaaaggauacguaggagguuccaauuauugcauagaaauuaccguaaaugauaagggcaaaugggagggagaagugauuucaacauuuagagcauauggaauaguaagagcgggagguaugggacgauuacguaauccccacgagggucagaaugggcgcaaauugauaaugagauuaguuauaggagacucgguaagacuagaaguagauggagcagaaagaacaaugcgaauaguaaaaauaagcggaagcaauggacagauauuuauggcaccaauacacgaagcaaauguagacgcaagaaauacagauaaacaagaugcguuuacauauacaucuaaauaugcaggaagucuacagaaagcgaaaacgagaagagucacgauaucaccuauaggugaaguaagagauccaggcuuuaaaggauga

SEQ ID NO: 4925 - RNA, 3096 nt, Artificial Sequence
  Cas9 variant
augccagcaaucuacagguuggcauuagaccugggaagcacuagccuuggaugggcgguacucagacuagaaccggcagcgcuagaaccgauagcaauaaucaaagcgggcgugagaauuuuuagcgaugguagaaaucccaaagauggcgcaaguuuagcuguaacacggagagcugcaagggcuaugagacguagaagagauagauuacucaaaaggaaagcaagaaugcaagacaaauugguaaaacauggguucuuuccaucagauauggaugaaagaaaagcacuugaaagacuagauccauaugcuuuaagggcuaaaggguuacgugaagcauuaacuccaggugaauuugcacgugcauuguuucacauuaaucaacgaagaggauuuaaaucuaauagaaaaacagauaagaaagacaaugacucaggugcgcuaaagaaagcuauaucgcauuuacggcaacaaauggaagcaggaggacacagaaccguaggugaucaccuauggucaagacugcaacaaggauugggcguaagagcucguuaucgagaaacaccauuuacuaaugaugaagguaagaaaagaauugauaaaucauaugaucuauacauagaccgcgccaugauagagcaagaauuugaugcacuaugggcagcucaagcugcuuucaauccggcuuuauuccaugaaguagcaagggcagaucuaaaagauacacuauuacaccaaagaaggcuaagaccagucaaaccugguagauguacacuguuaccagaggaagaaagagcaccucuagcacuuccaucaacacaacgauuccguauauaucaagaaguuaaucaucuacgccuauuaggagaggacuuacgggaaguagcauuaacacucgcgcaaagggaugcaguugcaaacgccuuggaaagcaaagcucgacuaacuuuugagcagauaagaaaguuauuaaaacuaucaggaaguguucaauuuaaucuugaagaugcaaaaaggacagaacucaaagggaaugcaacaucagcugccuuggcaagaaaagaacucuucggugcagcauggggaggauuuggagaagcucuacaagacgaaaucguauggcagcuagugacagaagaaggagagggagcauuaauugcauggcuacaagcucauacaggaguagacgaagcuagagcacaagcaauugcugaugcgaguuuacccgaaggauaugguagccuaaguagaaaagcucuggcuagaauuguacccgccuuaagagcaggcguaguaacauaugacaaagccguacaagcugcaggauucgaccaccacucacaacuaggauuugaauacgaugcuggagaaguagaagauuggguucauccagacacuggcgagauacgaccaguauucaaacaauuaccuuauuacggaaaaccacuccaacgacacgucgcuuuuggaucagggaaaccugaagacccagaugaaagacgauauggaaaaaucgcaaacccaaccguccauauaggauuaaaucaaguccgaacaguaguaaaugcuuuaaucagacgauauggucggccuacggaaguaguaauagaauuagcaagagaucucaaacaaucgagagaacaaaaaguagaagcacaaagaaaacaagcagaaaaucaaagacgaaaugcaagaauaaggaagucgauugcagagguacucggaauuggagaggaacaaguuagaggagcagauauccaaaaauggaucugcugggaagaacuaucuuucgacguugcugaaaggagaugcccauacucgggaguucaaauaagugcaaggauguuauuaagugacgaaguagaaguugaacauauccuuccuuuuaguaaaacucuagacgauaguuuaaacaauagaacuguagcgaugaggcaagcgaaccggauaaaacggaacagaacgccuuggacugcaagagacgauuucgaagcacaaggauggagcuaugaaggaauauuacaacgagcagaaagaaugccauuaagaaaaagauauagauuugcgccagauggauaugaaagguggcuaggagaugacaaagauuuucucgccagagcacucaaugauacaagauauuuaagucgagucgcagcggaauauuugagguuaguaugcccgggaucaggcacgagaguaaucccaggacaaaugacugccagacuaagagggaaauuugguuuaaacggaguucuugguccagacggcgagaaaaaccgcaaugaccaucgccaccacgcuguagacgcaugcgugauugguguuacugaucaaggauugaugcaaagauucgcgaacgcaagugcucaagcaagggaagauggacuaaccagauugguagaugauaugccuagaccguggccaacuuacagggcgcauguagaaagggcuguaagacauauuugggucucacacagaccggaucauggcuuugaaggagcaaugauggaagaaacgucauauggaauaggaaaggacggaagcauaaaacaaagaagaaaagcugauggcucaccaggccgagaaauuacaaaucuaauaagaauccaugaagcaacacaaccacagcggcauggagcuggaccagauggacagccacuaccauauaaaggauacguaggagggaguaauuauugcauagaaauaacaagaaaugauaaaggaaagugggaaggagagguuauuucuacuuuuagagcauauggcauuguaagaacaucaggccuagggcaacuuagacauccuagaguaggccaaaauggaagagagcuagugaugcguuuagugaucggagacucaguacgauuggaaauugacggaauagaaagaacaaugagaauaguaaaaauaaguggaucaaauggucaaauauuuauggcaccuauucaugaagcaaauguagacgcucgcaauagugauaagcaagaugcauuugcguacacaucaaaauaugcagguucguuacagaaaacgaaagccagauuugucacuauaucgccaauaggagaaguaagagauuugggcuucaaaggauga

SEQ ID NO: 4926 - RNA, 3099 nt, Artificial Sequence
  Cas9 variant
augaaaaaaagaauauuaggacucgacauaggaauagccaguguagguugggcgcuagucgaauuugacgaugaauuucaagauaauaaaaaaaaaggaacaauaauaaaaagcggcguaaggauauucacacgggcagaaacaccuaaagaaagagaaucacuagcuaaaccccguagggaagcacguucccaaagaagacgaauacgaagacguguagaaagauuaaacagcauuagggaauuauuuguaaaaaacggaguaguggaggaauggucaguaucaaaaaaaaacccaaauaauauauacaucacccuaaaccaaauaaagaccccauggcaauuaaggauggaaagccuugacagaaaauuaaccaaugaacaguuugcuguaguccuaacacauuuagcaaaacacagaggauauaaaagccuacgaaaagaugauaaagcaggaaaaguccuggaagcaauaucacaaaauaaaaaaagacuuaaugacagcgacuaucgaacauuaggugaaauguuuuguaagaacgaaagcuauaaagaacacaagcguaacaagggcggagaguacauaaauucaguagcacgagaauuaauugaagaagaaguagaaaaaauuuucguaaaacagagagaaaagggcaacaacuucgcagaugucaauacagaaagagaauaccuaaaaauugccuucucacagaaaccagccgguagcauaucaaaaaugguugguuucugcacauucgaaaacggagaaaaacgagcaccaagagauucauacagcgccgaacuauucaaagugcuauguacaauaaacaacacaacguuuacggauaugaaaacaggagaaauaagauccuuuagcaaagaggaaauaggaaagacucuagagacaguaaaaaacgucaaagauguaaaauaugcaaaaauaagaaaagaucuaggcuuagaagauagcguaaaauucaguggagucgacuaucgcgaaaaugcuaaaaguaaaggcgaaggugaaauauuuguaagcaugaaaaccuaucacgaaauuaaauccaaaauagaaaaacuaucaaaagaaaaaugggauaaccuaaaggguaauaccgaauuacuagacucaaucguaaauauaauagcuaacuugaaagacgaugaaaguauaaaaaaagaauuccaaaaacuuaaaauagacgaagacaucauagauguauuacuaaacuucgaauucaaaaaauuuaucaaccuaucauucaaagcacuaagaaaaauaauaccauuccaguuccaagggcaaaaauacauaacagccucgacauccgcagguuauucacucaagcaagaaggaaucaaaaauaaauuaguuccgccagcaaaagaaaacauaaauguggcagugguagcaagagccuuugcucaaacacgcaaaguaauaaacgccguaauaagaaaguacggacaguuugaccagaucaauauagaacuggcaacugaauugaaaaacuccaaauucgaccgaucaaaaauagaggagggacaaaagaaauuccaaucacaaaaagauaaaauauuuaaagaaguacaagaacuacgcggagggaugacgccaucauccucuuuacuccuaaaauacagauuauggcgagaacaagacgagagaugcguauacagcggaaggaaaauaucuuucgaagaucuauuagacaccggauuucuagacauagaucauauaauaccguacagcaaaucaauggacgauuccuucaacaacaaaguccuaugucuagcagaagaaaaucgaaacaaaaaaaaugauauaccauuuaacuacuaccaaagaauagaucgagauuggaaccuauuaauaaguaucauaacuagcaugaaaaacaugaaaauagccaaaaaaagcagauuacuaaaacaggaguuaagcgauauagaaggcuucauagaaaggaauauaaaugacacaagauaugcuacaagauauaucaaagauuuucuagaaaauaauuuagaauucaaagaaaacgaauucauaaaaguaaaaguacaagcucgauccgguggauuaacaucagucuuaaguuacaacugggguaugagcaaggacagagaagaaaguuacuuccaccaugcuaaagaugcaauaauaguagccuguagcacacaagggaugguacaauauauuucaaaaauaagccaacaauacgaaaaugacaaagacaagaugaaaaaaauaaaggauaaaacagaaaauuguauccccaaaccgugggacucauuccgagcugaugucgaagaaucuauagaagguauauuuguuaguuuugcgccaagacacaaaguuacagguagcgcacauaaagaaacuauauauagcaaaaaacaucucgaaaaagaaagguauguuacaguaaaaaagucauuagauaaaauaaaacuauccgaccuagaaaacauaccauguaaugaaaacugcgguaucauacgaguucuaaaagagaggcuagaaaaauucaaaaacgauaguuuaaaagcauuugcagacccaguacacaugccaaccaaaugcccgaacaaaaaaggaccaguaauccggagcguaaaaauaaaagaaucaaacaaaacaggcauagaagugagaaaaggauuggcagaacguggugaaaugguaagaguugauguguuuauaaaagauaaaaaauauuaucuagucccaauauacgucucagauuucaaaaauaaagauuuaccaaauaaagcaaucgcagcuuuaaaacuugaaaaugaauggaucaugauagacaaaaccuauagcuuuaaauucucacuauuuaaagacgaccuuauaaaaauaaaaaaaaaaaaagaagagaucuucgguuacuuuggcggagugcaucgcagcacuggaacaauaaaaauuaagagcagacacaaaccuaaagaaauagaugaagggauaggaucacgaugccuauuagacuucaggaaguuucaaguagacguacucggcaacuacaccgaaguaaaacacgagaaaagaaugccugcauauauaacaagaaaagacaaaaaacacuga

SEQ ID NO: 4927 - RNA, 3105 nt, Artificial Sequence
  Cas9 variant
augaaaauuuuaggauucgacauagggauagcaaguauaggaugggcauuugucgaaaacggagaacucagggauugugggguucgaauauucacaaaagcagaaaacccaaaaacaggagacucacuagcaaugccgcgaagagaggcaagaagcgucaggaggcgacuugcaaggagaaaagggcgauuagaaacauuaaaaagacuacuugcaaaagaaugggaucuaugcuaugaagacuacauagcagcagauggggaacuacccaaagcauucauggguaaaaaccuaacaaacccauacguucuacgguacgaagcauuacagagacuccugggaaaggaagagcuagcaagaguaauauuacacauagcuaaacauagaggcuacgguaauaaaaacgcaaaaauaacaaaaucugaagagucaaaaagagaacaaggaaaaauauuaucagcacucgccaccaacgcaagcguaauugcuagauauagaacaguaggugaauauuuuuauaaagaauucugugagguaauaaaaaacccccaaggauuaaacaccaaugaaaauuguacgcaaccaaaagucagaguacuaaaaccaauccgcaacaaaggaggugaauacacaaacugcauacuacaagaagacuuacagagagaguuacgauguauauuugaacaucaaaaaggauuuggguuuccaauaacucaagaauuucaagacaaaauucuuaaaauagcauuuuaucaaaggucacuuaaagacuucucacaucucguaggaaaaugcacauuuuauccugaugaaccccgugcaccaaaauucagucuaucagcuauagaauuuauaacaaaagcaaagacgaucaaucuccuuguaggaauugugaaggaaaguggugaagucugggauaaagaacaauggagagagcgucuugauuccguuuucagcgccgucugcgaaagaggaaaucuaacauucgcacaaaugcgaaaaauuuugaaaauagacgaacgaauacaauuuaaagaaguagauuauacggcuaaaaaucccgaaaacaaaaaauuugucgaauuuaaaaaucuaaaaaaauuuugugaaaucuuaggcgcaauaguuggagacagagcacuagcugauucuauugcgcgagacaugacccugaucaaagaugaagaagagcuagcgcaaaaacuacgaggauauggaaaauuuucccaagaacaaaucacacaacucggcgcauuaaacuuuagucaccauauaaacuuaucacucaaagcacuaagugaaauacuaccuuuuaugcgagagggaaugcguuaugaugaagcaugucaagaagccaagcuccaagcuaagcacaacgacaaaaaaaguaaguuccuaccucccuuuuguggaucuaucuaugcggacgagcuuacaaauccaguaguacauagagcgauagcagaauacagaaaaauauuaaacgcacuuauagccaaauauggcaacguucacaaaauucacauagaacuaacuagagauguagguaagaauuuucaggaaagagaaaaauauaaaaaagaaauagaaagcaacuacaaagcaagaguacaagcaaugcaagaaugugaaaaacuuggauuaacauuaucagaggguaauauauuaaaacuacgccuauucauggagcaaaaugaaagaugcguauauucagguagaaagaucacccuagcaaaccuuaaagaacaaggggccuuagaaauagaccauauccuaccauauagcagauccucagaugacucauacaugaacaaaguccuaguauucacaaacgaaaaccaaaacaaggggaacaaaacuccauaugaagcauuugguggagacucacaaaaauggggggaaauagaaaguuuagccuuacgaucuggauaccccaaaaaaaaagcaaaaagaauacucgacaagggauuuggggaccgggaagcuggauucaaaucaagaaauauaguugacucgggauauaucgcaagauuaauagcaaacuauacaaaagaauaccuaaaauuucuaccacuagauucacaugaaaauacagcacuaaucgcuggcgaaaaagauucaaagauacauguagaagcagucaaaggaauguuaacugcaacuaugaggcauuucuggggacugggaucaaaaaacagauaugaacauacacaccacgcaauagacgcaauuauaauagcauauaucaacgccgcaaugauacaaagauucagucaauuucgacaaaaccaagagucacuaaaagcacgcuucuaugcuaaagaauuagcgaaggaagaauucaaaacacaaagagcauucuuugagccauuuaguggauucagagaacaaguauuagcuaaaguaggucaaauauucguaucccgaccucccagaaagcgagcgcguggagcauuacaugaagaaaccuuuuauucaauagaugacaaaaaauugucagaaacauauggcggaaaggaaggaguacaaagagcgcucagccuaggaaagauaagacaaauaggaacaaaaauaguagcaaacggaccgaugguacgaguagauauuuuuaaacauaaaaagucaggaagguuuuacgcagugcccauauacacuauggauuucgcacugggcauacugccaaauaaagcuguggucucuggaaaagacaaugauagaauaauuaaagacugguuagaaauggacaguaacuacgaauuuuguuuuagcuuguuuaaagaugacguaauagaaguucaaaaaaaagauauggagaaaccagaauuagcauauuucguuucauuaaacacuucaucagcaagcauagcacucguaaaacaugacaauaaauucgaaacacugacuaguaaccaagcaaaauuauuuagcaaugcgaaagaaaacaacguaauugcagaaucauuggguauacaaaaucucaaaguauucaaaaaauauaaaguaucaccucucggagaaaucaaagaagccaaauacgaaccaaggcaaccaauagcacuaaagacaucaccaaagaaacauagaaaacaaaauaacgcacaauga

SEQ ID NO: 4928 - RNA, 3108 nt, Artificial Sequence
  Cas9 variant
augagacgauuagguuuggacuuagguacaaacagcauaggauggugccuuuuagacuuaggagaugauggagaacccguuucaauauucagaacaggugcaagaauauuuucagauggucgcgauccuaaaaguuugggaucauuaaaagcaacacguagggaagcaagacuaacuagaagacggagagauagauuuauacaaagacaaaaaaaucuaauaaaugcauuagucaaauaugguuuaaugccagcagacgaaauacaaagacaagcgcuagcauauaaagacccauauccuauacguaagaaagcacuagaugaagccauagauccauaugaaaugggaagagcaauauuucacauuaaucaaagacgggguuuuaaaucaaaccguaagucagcagauaaugaagcaggaguuguaaaacaaagcauugcagaccuggaaaugaaauuaggagaagcuggagcucgaacaauaggagaauuccuugccgaucgacaagcuaccaacgacacuguaagagcaagacgacuaaguggaacaaacgcauuauacgaauuuuauccagaccgcuauauguuagaacaagaauuugauacacugugggcuaaacaagcagcauuuaaccccaguuuauauauagaagcggcacgagaaagauugaaagaaauaguauuuuuucaaaggaaauuaaaaccacaagaaguuggacgaugcauuuuuuuaagugaugaagacagaauaaguaaagcacuaccaucauuucagagauuuagaauuuaucaagaacuaucaaaucuugcauggauagaucacgauggcguagcacaccgaaucacagcuagucuagcuuuaagagaucauuuguuugacgaauuagaacauaaaaaaaaacuaacauuuaaagcaaugagagcgauucuaagaaaacaagguguagucgacuauccaguuggauucaaucuagaaagcgauaaucgagaucaccuaauagguaauuugacaucauguauuaugcgagaugcaaaaaaaaugauuggcucugcaugggauagauuagacgaggaagaacaagauuccuuuauucuaauguuacaagacgaucaaaaaggggacgaugaagucaggucaauauugacucaacaauacggacucagugacgauguugcagaagacugccuagaugugagacugccagauggacauggaaguuuauccaaaaaagcaauagauagaauauuaccaguacuuagagaucaaggauugauuuauuaugacgcaguuaaagaagcagggcuaggugaagccaaucucuacgacccuuaugccgcacucucagauaaacuagauuauuacggaaaagcucuagcaggccaugucaugggagcgucuggcaaauuugaagauucugaugaaaaaagauacgggaccaucaguaauccaacaguacacauagcacucaaucaaguuagggcaguagucaaugaguuaaucagacuucacgggaaaccagaugaaguaguaauagaaauaggcagagacuugccaaugggcgcugacggaaaacgagaacuugaaagauuccaaaaagaaggcagggcaaaaaacgaaagagcaagagacgaauuaaaaaagcuaggacauauagacucuagggaaaguaggcaaaaauuucaacuaugggaacaauuggcuaaagaaccgguagaccguuguugcccauuuacaggaaaaaugauguccauuucagauuuguucucagauaagguugaaaucgaacauuuauuaccuuuuagucucacuuuagaugacucuauggcaaauaagacuguauguuuucgacaagcuaacagagacaagggaaauagagcaccuuucgaugcuuucggaaacucaccagcaggauaugauuggcaagaaauucuaggacgaagucaaaauuuaccauacgcgaaaagauggagauucuuaccagacgccaugaaaagauuugaagcagauggagguuuucuggaaagacaacuaaaugacacuagauauauuucucguuacacaacagaauacaucucaacaaucauaccuaaaaauaaaaucuggguaguaacgggacgacuuacaucguuacuacgcgguuucuggggauuaaacaguauacuaaggggacauaauacugacgacggaacaccggcaaaaaaaucaagagaugaucaucgacaucaugcgauagaugcaauaguuguaggaaugaccagccggggacuguuacagaaaguaucuaaagccgccagaagaucagaagaucuagaucuaacgagauuguucgaaggacgaauugauccuugggauggauuucgugacgaaguaaaaaaacacauagaugcaauaauaguaagccaucgacccagaaaaaaaagucaaggggcuuuacauaaugauaccgcauacgguaucguugaacaugcagaaaauggugcaaguaccguaguacaucguguaccuaucaccaguuuagguaaacaaagcgauauagaaaaaguaagagauccacucauaaaaucagcauugcucaaugaaacggcaggauuaucaggaaaaaguuucgaaaaugcaguacaaaaauggugugcagauaacaguauaaaaucgcuaagaauaguugaaaccguaaguauaauuccaaucacugacaaagaagguguagcauauaaaggauacaaaggagauggaaaugcauacauggauauauaccaagauccaacaucaaguaaauggaaaggggaaauaguuucucgcuuugaugcaaaccaaaaggguuucauaccaucauggcagucgcaauuuccaacagcucgauuaauaaugcgacuaagaauaaacgauuuacuaaaauuacaagauggcgagauagaagagauauauagagugcaacgacuaagugguucaaaaauacuuauggcaccacauacagaggccaauguagaugcaagagauagagacaaaaacgacacauucaaacuaaccaguaaaaguccgggcaaacuacaauccgcuucggcaagaaaagugcacauaagcccuacaggacuaauaagggaaggauga

SEQ ID NO: 4929 - RNA, 3108 nt, Artificial Sequence
  Cas9 variant
auggaacaauuaaauuacauauuaggacuagauauaggaaucgcaagcgucggaugggcaguaguagaaauagaucacaaugaagauccuauccgauuaauagauguaggaguaagaacauuuaauaaagccgaagucgcaaaaacaggagaaaguuuaagccuaauaaggagauuggcaaggggguccagaagguugguacgucguaagaaaaugcgacuacucacagccaaaagauuacuaaaaagugaaggcauacuaagcgacuuagauuucaauaaaggagcuauacuaaacuugccgaacaauugcugggaacugcgaguaaaaggacucgacaagaaauuaagcgauaaagaaugggcagcaguucuauuacauauaaucaaacacagaggauaccuaucacaaagaaaacaugacagaaaaacggaugauaaagaacugggagcauuauuauccggcgugaguaaaaaccacucacuacuagaagagggagaauuucgcacagcagcagaauuagcaaucaauguguuuugcaacucaaaaggacacauaagaaaucaauggggagacuauagccauacauuuuccagacuagaccuccaaaaagaaauuaaacaauuauucguaagccaacgugaauuagggaaucccuauacaucaucaucauucgaagaaaauauuauaagccuuuuaaugaaacaaaaagaagccauaucagguaacgacauauugaaaaugcuaggaaaaugcacauacgagaaaaaugaauauaaagcagcuaaaaacacauauagcgcagaaagauucguauggcuaacaaaauuaaauaacuuaagaauaguagacgauggagucgaacgcgcauuaaacucaagugagagaaaauugcuaauagacgaacccuauaagaaagcuaaacucacguaugcccaaguucguaaaauacuagaauuaccagacagcgcugucuucaaaggaguaagauacuuugcugauaacgcagagagcucaacauuaauggaaaugaaauuuuggcauucgauacgaaaagcauuggaaucgaauaaccuaaaagacgaaugguuaguacuaaaaacaaaaccagaauuacuagacgaaauaggaacaggguuuagcauauacaaaacugaugaugauauaaccuccuaucuaagcaacaaauuagauaaaaagguacuagacauacucuuagucgaaguauccuucgauaaauucauagaauuaaguuuaaaaugccuuagaaaaauaauuccacuaauggaaaaaggauacagauaugacgaagccuacaaauauaucuauggggaaguaaauaucgaauauaaccuuaaugacauaaagaauccgguuguguuaagaaguuuuucccaaaguagaaaaguaauuaacgcggucauaagauuguacggcucaccagcuagaauacacauagaaacggcgagagacauugguaagaguuucaaagaaagaaaagcaauagaaaaacaacaggagaaaaacagguuagaaaaaguccgagcggcggaacacuucaaacaacuauuuccuaauuauguaggagaacccaaagcaaaagauauucuaaaaguacgacuuuacgaacaacaacagggaaaaugucucuauucaggcaaaauauuagacaucaaacgauuaauggaacacgguuauguagaaauugaccaugcacuccccuuuucacgaacaugggaugauucuuucaacaacaaaguauuagucuuagcaaaugaaaaccaaaauaaaggaaacaaaaccccauaugaaugguucaauggcaaagauaacucagauagcuggaaaagauucuuagcauuaguaaauaacuccggauucucggcaguaaagaaacaacauauuuuaaugaaagaaauagacgaggaaggauuuaaacaaagaaacuuaaacgacacuagguacauaacaagauuucuuuguaacuggguagaaaauaacaucccucuuuuaggaaaagguguaaaaagaguauuugcaccccaaggcaaaauaacagcacuacuaagaucaaauuggggaaucagaaaaguaagagaagacaacgaccgucaucaugcaauugacgcaauaguaguggcuugcacaacuguaucaauacaacaaagaauaacaaacuauguuaaaaacagugaaauuaacagaaaaauaaaaagacaaaacuaccuuaaauucccggaacccuggaaauucuucagagaagacauaaguauccgaguauuuucuaauaacccuauugaagaacucaaacaacaacuaagugaccgacccgaagcuaaucaccaauucguaacaccacuauuuguaucaagagcgccagugcgaaaaaugacaggacaagggcaugaggacaccauaagauccgcaaaaagaauauccgaagguaucagcgucuuaagaguaccacuaacuaaauuaaacgauaagagucuagagcuuauggugaacagagaaagagaaaaagagcuauaugaugcgcuuaaacaaagacuccucgaguucaaaaacgacccugaaaaggcuuuugcugaaccuuuuuauaagaaaggagggcagcaaguaaaaaccguuagaauagaaagaguucagaaaaauggaguauugguaaacaacaacacaggcauagcagauaauggcaacauaguaagagucgaugucuuuuuaaagaagaagaaauacuucuuaguaccaauauauuccuggcaaguagcaaaagggaucuuaccuaauaaagcuauaguagcacauaaaaaugaaugugacugggccgacauggacgggucagcccaauuucuauuuagcuuauauacaaacgaccugaucgaagucguauuaaaagauagcaccauauuaggauauuucaguaguauagaccgagccacagcagcaaucauaauuaaagaaccagauauggaaaaaucuaaaggaaaagaaggaauacacagaguagguguaaaaacagccaggagcuuuauaaaauacaacguagacguccuagggaaaaacauuuccagauguagaaaagccaaaagauuaccaguaagauga

SEQ ID NO: 4930 - RNA, 3108 nt, Artificial Sequence
  Cas9 variant
auguuacggaagaugcauuauagauuagcauuagaucuggguaguacaagucuggguugggcuaugauccgacuaaaugcaggaaacgaacccugcgcaguaauaaaagccggaguacgaaucuucaguaauggaagaaacccaaaggacggaagcucauuagcaguuacgcgaagagaggccagagcuaugagaagaaggagagaccguuuauuaaaaagaaaagcaaggaugauacaaacuuuaauagaauauggguucuuuccagcgaaagaagaucagaggaaagcacucgaaauuaugaauccauuugcauuaagagcaaaaggauuaaacgaagcauuaacaccagcagaauuugcaagagcacuauuucauauaaaucaaagaagagguuucaaaaguaaccgaaaaacagauaagaaagauaacgacuccggagcauuaaaaacugcuauuaauaaacuaagggaaacauuaaaaacagagaacugcaggacaguaggugaauggcuuaacaaacgagacguagccggacuaacagugagagcaagauaucaccaggauaaaacaauaaaagaagaugguaaaaguaaaauaaacaaguacuaugauuuauauauugacagagcaaugauagagcaugaguucgaugaauuauggaaaaagcaagcggaauuaaauccgacucuauucaccgaagcagcacgagcagaucuaaaagacguauuacuccaccagagagcucuaaaaccaguuaagccaggaaggugcacauuuaugccggacgaagaaagggcuccucuagcacuaccuucgacgcaaagauucagaauguaccaagaaguaaacaauuuacguauauuaagagaugguuuaaaagaagaaucacuuacacugaaccaaagagaugaucuaauagcagcauuagaggaaaacaauaaaagaaccuuuacacaaaucaagaaauuacuaggacuagguggcguaguuaaauuuaacuuugaagauccuaaaagagaggaauugaaaggaaacacuacaagugcaauauuaggaaaagacgaacauuuuggauccguuugguuuaaauuugaugaagccaaacaggacgcgauaguaaugcaauuauuuaaagaagagaacgaagcaaaacuacuaagauggcuacaaaaugaaacuggaauagaugagaaaagagcugaaacaauagcuaauguaggccugccagaaggauacggaucauuaugcgcuuuagcacuggcaaggauuuuacccgaauuaagaagagacguaguaccauacucagacgcagcaaaagcagcaggauuccaucacagcgacacaagcaauaaucaagaagucccuggauuaaccuucccaauagaacuuguaguaacagaaaccggagagauaaaaacaaaacauaucuuccaugaauuacccuauuauggagaauacuuacaaagacauguaggguuugggaguggcaagccagaagauagcgcugagaaacgauaugguaaaauagcaaauccaacaguccacauaggauuaaaucaaguuagauugguuguaaacacacuaauaaaaagauauggacauccaagugaaguuauagucgagguagcucgagacuuaaaacaaagcaaagauuuaagagaugaagaaggaaaacgucaagcagaaaaucaaaaacgaaauaaacgaauacgaacagcuauagcaggaguacuucaaacaagugaagaaagaguuagaagggacgauauagagaaaaugauacuaugggaagaauuaucuuuugacccagcugauagaagaugcccauauucaggcguucaaauaucugcagcaauguugcuaucugacgaaguagaaauagagcacaucuuaccguucucacaaacauuagacgacagccuaaauaacaaaacaguugcacucaggcaggcaaauagaguaaaaggaaaccgaacuccaugggaagcauucggagcccagaguacggccggcuucgacuaugccacaauacuggcacgagcagaacauaugccaaaaggaaagagauaccgauucgcagaagauggcuaccaacguuggcuaaaagacgacgcaggauuucuaccucgugcgcuaaacgauacuagacauaugaguaaagucgcaagagaauacaugagccuaauaugcccuaauaccagaguuauaccaggacgaaugacggcaaugcuaagaggaaaauuuggauugaacgacguauugggucuaaauggagagaaaaaucgaaaugaucaucgacaucacgcaguagacgcuugugucauagccguaaccgaucaagguuuacuacaaagauucgccaaagcuagugcgagcgccagggaacagcaacuaaacagauuagucgaaaauaugccacuccccugggaauccuauagagaacauguagaaagagcaauagacgcaauauggguaagucauaaaccagaucauagucaugaaggcgccaugcauaacgacacagcauauggacuauuaggagauggaaaaguauccauacauaaaaugguagaaggaaaaagagaacgaaucgaagaaucauuaaaaguuaucgcuuuuacaaacgcaaaggccaaugauagacauggacuccuagacaacggagaaccaagaccauauaaaggauauaagggagauaguaacuacugcauugaaauuauaagaaaugaaaagggaaaaugggaaggggagguaaucaguacauuugacgcauaccaauuaguacgagagcauggcguugcaagauugagacauccgacuuugucaguaagcggaaaaccuuuagucaugagacuaaugaaagacgaaacaauacgcaugguaaccaacgaaaaaccgauaacugcaagggucugcuggguuagaagugauacucgaauagcauucgcuucaacuucggaagccaauguagaugcucgagacagagacaaaaaugauucauucucauauauaguaaaaacagcaaguguccuacaaaaauuacaagcaagaagaauaucaauaaguccaacaggagagcuaagagaccccggauucaaagaauga

SEQ ID NO: 4931 - RNA, 3108 nt, Artificial Sequence
  Cas9 variant
auggaacaacuaaacuacauauuaggauuagacauaggaauugcuucagucggaugggcggucguagaaauagaccauaacgaagauccaauaagguuaauugacguaggaguacgcacauucaacaaagcugaaguugcaaaaacaggagaaagccuaucacuaauaagaaggcuagcucgaggaagcaggaggcuaguaagaagaaagaaaaugcggcugcuuaccgcuaaaagauuacuaaaaagcgagggaauccugucagacuuggacuucaacaaaggagcaauucuuaacuuaccaaauaacugcugggaacucagaguaaaaggccuagacaaaaagcugagugacaaggaaugggccgcaguguugcuacauauaauaaaacaucgugguuaucuaagucaaagaaaacaugauagaaaaacggaugauaaggaacuaggugcucuacuaagcggcguaucuaaaaaccauucacuacuagaagagggugaauuuagaacagcagccgaacuagcuauaaacguauuuugcaauuccaaaggucacaucagaaaccaauggggagauuacucacacacuuucagcaggcuagaucuacaaaaagaaauaaaacaauuguuuguaagccaacgagaacuagggaacccauacacauccucgaguuuugaagaaaauauuauaucucuauugaugaaacagaaagaagcaauuucaggaaacgauauucuaaaaauguuaggaaagugcacauaugagaaaaacgaauacaaagccgcuaaaaauaccuauucugcugaaagauucgucuggcugacaaaauuaaauaacuuacgaaucgucgacgacggcgucgaaagagcuuuaaacaguagugaacgcaagcuauuaauagaugaaccauacaagaaagcaaaacuuacauaugcacaagugcgaaagauauuagaauuaccagacagugcaguauucaagggaguuagauacuuugccgacaacgcggaaagcucaacauugauggaaaugaaauucuggcauagcauaagaaaagcacuagaaucgaacaaucuaaaagacgaauggcuaguauuaaaaacaaaaccugaacugcuugaugaaauaggaacaggauuuuccauauauaaaacugacgacgacauaacuagcuauuuaaguaauaaauuagacaagaaagucuuagauauauuacucguugaagucaguuuugacaaauuuauagaauuaucucuaaaaugccuuagaaaaauuauaccauuaauggaaaaaggauauagauacgacgaagcauacaaauacauauauggagaaguaaauaucgaauauaaucucaaugauaucaaaaacccaguaguauuacgaucauuuagucaaucaagaaaaguaauaaacgccguaaucagacuauacggcucaccagcaagaauacacauagaaaccgcaagagacauaggcaagaguuuuaaagagagaaaagccauagaaaagcaacaagaaaagaaccgauuagaaaaaguucgagcagccgagcauuucaaacaacuauucccuaacuacguaggugaaccaaaagccaaagacauauuaaaagucagauuauacgaacaacaacaaggaaagugcuuauacaguggaaaaauccuagacaucaaaagauugauggaacacggauacguagaaauugaccaugcccucccauucucgcgaacuugggaugacucauucaacaacaaaguauuagucuuagccaaugaaaaccagaacaaaggaaacaaaaccccguaugaaugguuuaacgguaaagacaacucagauagcuggaaaagauuucucgcauuaguaaauaacucgggauucucagcaguaaagaaacaacauauacuaaugaaagaaauugacgaagaagguuucaaacaaagaaacuuaaacgauacaagauacaucacaagauuccucuguaacuggguagaaaacaauauaccccuauuagguaaaggaguaaaaagaguauuugcaccacaaggaaaaauaaccgcuuuacugcgcaguaauuggggcauaagaaaaguaagagaagacaaugacagacaccaugcuaucgaugcaauaguuguagcaugcacuacuguaucuauucaacagagaauaacaaacuacguuaaaaacagugaaauaaacagaaagauaaaaagacaaaacuauuuaaaauuuccagaaccguggaaguucuuuagggaagacauaagcauaagagucuucucaaauaacccaauagaggaacuuaaacaacaacuaucagaucggccagaagcaaaucaccaauuuguaacuccauuauuuguaagcagagcgccaguaaggaaaaugacaggccaaggacacgaagauacaauaagaagcgcaaaaagaauaagcgaaggaauaucaguauuaagagucccccucacaaaauuaaacgauaaaucauuggaacuaauggugaauagagaaagggagaaagaacuuuaugacgcauuaaaacaaagguuacuagaguucaaaaacgaccccgaaaaagcauuugcagaaccauucuauaagaaagguggccaacagguaaaaacagucagaauugaacgaguccagaaaaauggaguuuugguaaacaauaacacaggcauagcugauaacggaaacauaguaagaguagacguauuuuuaaagaaaaagaaauauuuucucguaccaauauacucguggcaaguagccaaagguauacuuccuaauaaagcgauaguagcacacaaaaacgaaugcgauugggcagacauggacggaagcgcgcaauuccuauuuucacuguacaccaacgauuuaauagaaguugugcugaaagacucuacaauccuaggguacuuuaguucaauugacagagcaacagcugccuugauaauaaaagaaccagacauggagaaaagcaaaggcaaagaaggaauacaccgaguuggaguaaaaacagcaagaucuuuuaucaaauacaauguagauguucuagguaaaaacauuaguagaugcagaaaagcaaaaagacuucccgucagguga

SEQ ID NO: 4932 - RNA, 3111 nt, Artificial Sequence
  Cas9 variant
augagaauauucgguuucgacaucggcaucacaucaauaggaugggcauauguugaaagcaaugaacucaaggauuguggcguaagaauauuuaccaaagcagaaaacccuaaaaacggaaaaagccuagcacucccaaggcgagaagcacguggugcacgaaggagacuugcacgcagaaaggcaagacuuaacgcuauaaaacgauuacuaugcaaagaguucggcuuaaacguaucagacuacuuugcaaacgauggugaauuaccaaaagcauaugaaacaacaaaagacacuaaaucaccauaugaacuaagaucccuggcauuggaacaaaaauuagaacccaaagaacuggcuagaguaauauuacacauagcaaagcaucgaggcuauggaaauaaacacgcaaaaacaggaucagauaaagauaguggcaaaguauuauccgcaaucaaaguaaaugaaacugccaugaaagacaaauaccaaaguguaggcgaauaucuauacaaggaguucuaccagaaacuaaggcucgaaagcgaaaagaaaggaaacaacauaacaaaagaguucaaaaacgucagaaacaaaggagaaaauuacgaacauugugucgcgcaagaacaaguacgagcugaauuagaacuaauuuucgcaaaacaaaaagauuuuggagcuacuuucucagaaaauuucgaaucacagauuauagaaaccgcuuucuaucaacgagacuuaaaaaguuucgaagauaaaguagguaaaugcguauucuaugaaaacgaaaauagagcaccaaaagacucacuaagugccauggaauuuguagcuuuaacuagaauaauaaauaccuugaaaaauuuggaagagaaaaguaaaaaccuaggaaucggagaagucuauggaaaagacaaaauacaggaaauacuuaaaauaguccuagauaaaggcgaaaugagcuacaagaaacuaagagaaauauuacaccuagaugaacacauacuauucgcaaaagacagcaaacuggacuacacccaagguguacaagaagcagaaaaagcaaaauucaucgaacuaaagaaucuaaaagcauuuaagaaagccaugggaggagacuuuagcaacuucgcgagagaagaauuagacaaaauagcaacagauauaacacucguuaaaagcaaagaaaauuuagccaagaaauuacaaaauuacagugcacuuucaaaagaacaaguugaagcccuuucgaaccuaaguuuugcgaaacauauugaccuaaguuuaaaagcacuagaacaaauccuaccguucaugagaggagacaaaacagguaaaugucuacgauacgaugaagcagucaagaaagcagaauuacaagaacacagaaaacauaaacaaaaaggagaguuccuaauuccgcuaaaagacuacgaaccauacuuagcaaauccaguaguggcgagagcacuuucagaauaucgaaaaguacuaaacgcgcuauuaagaaaauacggaaaagugcacaagauacaucuagaguucacaagagaagcaaaauuaucugcaaaagaacgacaaaaauaugaaaaagaacaaaaggaacauuuugaagcaaaucaaagagcaauccaacagugugaaauacuaggccuuccaauuaauggaacaaauauauuaaagaugaaacuauggcuagaacaaggggaauguugcgcauauuccggagagaaaauaacaagagaacaucuucuagauagcaaugcguugcaaguagaccauauuuacccauauagcagaucauuugacgauucuuauaugaauaaaguacuggucuucgcaaaagaaaaucaagacaaaggaaauaaaacaccauucgaagcauuugggggcgauaaggaaaaaugggaucguauauuaucauuaagcgcgaaacuacccaagcaaaaacaacguagaaucucaaauacaaauuuuaaagauaaagaaggaggauucuuagcaagaaaucuaaacgauacuggauauauagcgaaauuagcaucacaguggaccaaagacugccuagaguucgaagaccuaagagaaaaugaaguaacuaucgcaggagaaaagggaagcucaguucauauagaagucguaaguggccaauuaacuagcauguugagacacuacuggggacuaggaaacaaagaucguaauaaccacuuacaccaugcugucgacgcagucauauuagcuuauacaaacaacgcaaugauuaaagccuuugcuaacuucagaaagaaucaagaagaaaauaaaaagaaauucuaugcaaaacaaauagcagaaucagaauauaaagcaaagaaagccuucuucgaacccugcaaaaauuuuagacaaagagucgaagagaaaaucaaagaaauuuucguaucuaaaccuccgagaaaaaggguacgaggagccuuacaucaagaaacauuuuacccauuugaaaaguuaugcaaugacaaagaauacucagaaaaacuaaaaauggauuacgggggagaaaaagguaugcaaaaggcaauagcauuagggaagauacgccaaauaggaacgaaaauuguaaguaauggagccaugguuagaguagacaucuuuaaagauaagaaagguaaguucuaugcggucccaauauauacaauggauuuugcacuaggcauucuaccaaauaaagcaguugcuauuggaaaagauaaagauggaguaauaaaagacuggauagaaauggauaguaauuacgacuucugcuuuagucuauuuaaagaugauuuaauuuuaguccaaaagaaagaaauggaaagagcugaacuauguuacuuuguuucauucgguaguacaaacgcacaaauaaacguagaaaaacacaauaauaaauucgaaggauuaagugagaacgagaaaauauuauacuccaaugcgacccaaaaagaaguagcaggaaaaucaauagguauacaaaauuuaaaaacauuugaaaaauaccaagucagccccuuaggggaaguacagaaagcagaguucgaaccacaccaagaaaucaaacuaaaaucaaguccgaaacgaaaggacuga

SEQ ID NO: 4933 - RNA, 3111 nt, Artificial Sequence
  Cas9 variant
auguugcacaaaaugcauuauagacuugcacuugaucucggaucaacaucacuaggaugggcaaugauaagauuagacgccgauaaucaaccgugcgcaguuauaaaggcuggaguaagaauauuuaguaauggcagaaauccaaaagauggcagcucguuagcagucacuagaagagaagcuagggcaaugaggagacgaagagaccgucuucucaaaagaaaagcaaggaugaugaggacacuaauugaauacggauuuuucccggcagaagcagcgcaaagaaaggcauuagaaacaauuaauccauuugcauuacgggcaaaaggacuagacgaagcucuaacaccagcagaguucggacgagcauuauuucauauaaaccaaagaagaggguuuaaaaguaauagaaaaacagacaagaaagauaaugauucaggugcgcuaaaaacugcaauuggaaaagugagagcaacaauagaagcagaaggaugccgcacaguaggagagugguuacacaaaagagacguagcaggacuuacuguaagagcaagauaucaucaagauaaaguaauuaaagaggacggaaaaacuaaaauugauaaauauuaugauuuauauauagaccgagcgaugauagaacaagaauuugaugaguuauggaagaaacaagcagagcuuaaccccgcauuauucacagaggcagcgagagccgacuuaaaagauguacuuuuacaccaaaggccguuaaagccgguaaaauccggaagauguacauucaugccggacgaagaaagagcgccacuggcacuaccuucaacgcaaagauuccgaauguaucaagaaguuaacaauuuaagaauacucagagacggauuaaaggaagaaccauugacuuuaaaacaaagagaugauuuaauugcugcuuuagagaaaaauuccaaacacagcuuuacacaaauuaaaacacuacuaggagucgguggagcaguacaauuuaauuuugaagaucuaaaacgacaagaacuuaaaggaaacacuaccagugcaauauuaucgaacgauaaacauuucggaaaagccugguucacuuuugacgaagcuaaacaagaugcuaucguacuucaauugguuaaagaagaaaaugaagcuaaauuaguuagauggcuucaagaugaaacagguauagaugaaaaacgcgcggaagcaauugccaauguuggguuaccggaaggauacggcaguuuaugcgcaaaagccuuagcacguaucuuacccgaacuaagaagggauguaaugacauaugauaaagcaguacaagcagcggguuucgaacaucacucaagacuuggaucaaacacugaaaucccaggauuaacauucaaaauagaaucuauagaucaagacagcggagaaguaaaacaauuccauauacauaaagugcuaccauauuauggagaauaccugcaaagacauguagguuucgguaguggcgaaccagaagacccagcagagaaaagauacggaaaaauagcaaacccaacaguccauauuggacuaaaucaaauuagguuaguaguaaaugcauuacuuaaacgauauggucauccaagcgaggugauaguagaacucgcaagagaucuaaaacaaaguaaagaucaaagagacgaggaaaguaagagacaagcagaaaaucaaaaacgaaauaaaagguuaagagaugcaaucgccgguacauuaaaaauuucagaagaaagaguaagaagagaugauauacagaaaaugauauugugggaagaauuaucuuuugauccggccgacagaagaugcccuuauucaggagcccagauaagugccacaaugcuacuaagcgacgaaguugaaguagaacacauacuaccuuucagccaaacacuggaugauucauuaaacaacaagacagucgcguuaaggcaagcaaauagaauaaaaggcaaccgaacaccaugggaugcuuuuggggcacaagcagucgcuggauuugauuacgagucuauacuuguaagagcugaaggcaugccaaaagcaaaaagguauagauucgcagaaaacgguuaccaacggugguuaaaagacgaugcaucguuuuuagcacgcgcauugaaugauacuagacacauguccaaaguagcauucgaauaccuaaaacuuauaugccccaauacaagaguaauaccaggacgaaugacagcaaugcugcgagcaaaauuuggguuaaaugauguacuaggacuaaauggagagaaaaauagaaaugaucacaggcaccaugccguagaugcauguguaauagcaguuacagaucaaggccuauuacaaagguucgcuaaagcaucagcaucagcuagagaacaacaauuaaauagauuaguugaaaacaugccucuaccguggggaagcuaccgagaacacguacaaagggcuauaaaugccauauggauuucccauaaaccagaucacucucaugaaggugcaaugcauaaugauacagcauauggauuacgaggagacggaaagguuagcuuucauaaaaugguugaaggaguacguacucauagcgaagauaaccuaaaaguaaucgaaauaucaaaugcaaaagcaacugaccgacaugggcuacuuccaaauggugaaccacgacccuauaaagguuacaaaggugacaguaacuacuguauagagaucguuagaaaugagaaagguaaaugggaaggcgagguuauaucaacauucgaagcauaccagcuaguccgagaacacgguauagcucgauuacgccacucgacauuaagcguaagcgguaaacuauugguaaugagacuaaugauagacgacguaguacgauuaauaauagaugaacaaacuagaacaaugagaaucgcuacacuuaguggaaaugggcaaauauucauggcagacacaucagaggcgaauguagaugcaaggaauagaagcaaagaagaaacauuugcuuacguaucaaaaauggccgggucauuacaaaaagccaacgcgcgacgaauaaacauaaguccaauaggagaacuccgagacccaggcuuuaaagaauga

SEQ ID NO: 4934 - RNA, 3114 nt, Artificial Sequence
  Cas9 variant
auggaaagaauuuuugguuuugacauuggaacuacaaguauuggguuuuccgucauugauuacaguucgacacagagcgcaggcaauauacaaagauuagguguccgaauuuuuccggaggcgagagauccagauggaaccccucugaaccaacaacgacgccagaaaagaaugaugagaagacaauuaagaagaagaaggauacgcagaaaagccuugaacgaaaccuuacaugaagccggauuuuuaccugcuuauggcucagcagacuggccuguagugauggcggaugaaccauaugaguuaaggagacggggacuagaagaaggauuaagcgccuaugaguucgguagagcaauuuaucaccucgcacaacaccgacauuucaaaggaagagaauuagaagaaucagauacuccagacccugacguagaugaugaaaaagaagcagcuaaugaaagggcugccacacuuaaagcauuaaagaaugaacagacuacacuaggagcuugguuagcgcgaagaccgccaucagacaggaaacgaggaauacaugcccacagaaacguaguagcagaagaguucgaaagauuaugggaagugcaaagcaaauuccauccagcauuaaaaucugaagagaugagagcaagaauaagcgauacaauauuugcacaaagacccgucuucuggcguaaaaauacccuaggagaauguagauuuaugccaggugaaccauugugcccaaaaggaaguuggcuaucccaacaaagaagaaugcucgaaaaauuaaauaauuuagcaauugccggugggaacgcaagaccauuggacgcagaagaaagagacgcgauauugucuaaauuacaacagcaggcuucaaugucauggccaggaguaagaucagcacucaaagcacuauauaaacaaagaggugaaccgggagcagagaaaaguuuaaaauucaauuuagaacucgguggagaauccaaauugcuagggaaugcuuuagaagcgaaauuagcagauauguucggaccagauuggccagcucacccaagaaaacaagaaauaagacaugcaguacacgaacgcuuaugggcagcugacuacggcgaaacaccagacaagaaaagaguaauaaucuuaucugaaaaagauagaaaagcucauagagaagcagcagcaaauuccuucgucgccgauuucggaauaacaggagaacaagcagcgcaauugcaagcauuaaaacuaccgacaggaugggaaccguauucaauucccgcgcuaaaucucuuccuagcagaauuagaaaaaggcgaaagauucggagcacuugugaauggaccagacugggaaggauggcgaagaacaaauuuuccacauagaaaucaaccgacaggggaaauuuuagauaaacuuccuucgccagcgucuaaagaagaaagagaaaggauaucacaauugaggaacccuacaguuguaagaacacaaaaugaacucagaaaaguagucaacaaucuaauuggucucuauggcaaaccagauagaauacgaauugaaguaggaagagacguuggaaaaucaaaaagagaaagagaagaaauacaaaguggaauaagaagaaaugaaaaacaaagaaagaaggcaacugaagaccuaaucaaaaacggcauagcuaacccaucgcgagacgauguugaaaaauggauauuauggaaagaaggacaagaaagauguccauauaccggcgaccaaauagguuuuaacgcacuauuuagagaaggaagauaugaaguugaacauauauggcccagaagccgaucauuugacaacucaccacgaaacaaaacacuuuguaggaaagacguaaauauagaaaaaggaaacagaaugccuuucgaagcguuuggccaugaugaagaccgauggucagcaauacagauuagacugcaaggaaugguaucagcaaaaggcgguacaggaaugaguccuggaaaaguaaagagauuucuagcaaagaccaugccagaagauuuugcagcaagacaacuaaacgauacaagauacgcugcaaaacaaauauuagcacaauuaaaaagacuauggccugauaugggaccagaagcaccaguaaagguggaagcaguaacaggucagguaacagcacaguuaagaaaauuguggacauuaaacaacauacuugcagaugauggagagaagacuagagcagaccauagacaucaugcaauugaugcauuaacaguggcuuguacacauccagguaugacuaacaaacuuucacgauauuggcaacuaagagacgauccacgugcagagaaaccagcucuaacuccacccugggacacaauuagagccgaugcagaaaaagcuguuagugaaauaguaguuucacaccgaguaagaaagaagguaucaggaccuuuacauaaagaaacaacauauggugacacggguacugauaucaagacaaaaucagguacauacagacaauuugugacucgcaaaaagauagaaaguuugaguaaaggagaacuugaugaaauaagagauccaaggaucaaagaaauaguugcagcacacguagcgggaagaggcggggaccccaagaaagcauuuccaccauaucccuguguaaguccaggagggccagaaauuaggaaaguaagauuaacaucaaaacaacaacuaaaccugauggcucagacagggaauggauaugcagaccuaggaucaaaucaucauauugcaauauauagguuaccugacgggaaagccgauuuugaaauagucagcuuauuugaugccucucgaagauuagcacaaagaaauccuauuguacagaggacaagagcugacggcgcuucauuugugaugucacuagcagcuggggaagcuaucaugauuccugaaggaucaaagaaagguaucuggauaguacaaggcguaugggcaucaggacaaguuguauuagaacgagauacagacgcugaucauagcacgaccaccagaccaaugccuaauccuauucucaaagacgaugcuaagaaaguaagcauagacccaaucgguagaguaagaccaucaaacgauuga

SEQ ID NO: 4935 - RNA, 3117 nt, Artificial Sequence
  Cas9 variant
auggcaaaacaagucagauacagauuaucacuggaccuuggaaguacaagucuaggaugggcuauauucaggcuagacgcugaugcacauccaacagcuauaauaaaagcugguguaagaauauuuucggacggacgaaaugcaaaagaugguucuucacuagcuguaacgaggcgagcugcaagaucaaugagaagacgacgagacagauuacuucgcagaaaaacccgaaugcuagaugcauugcuggaauauggauuuuucccacaagacgcagcacaaagaaaagcacuagaaaggcuaaacccauaugcucuaagggccgaaggauuagcaagaccauuaacaccaggagaguucgcaagagcuauuuuccaccuaaaucaaagaagggguuuuaaaucaaauagaaaaacagauaaaaacgauaacgacucaggagccuuaaaaacagcuacaagucaauuaagacaagauauccaagcgucaggaugccgcacuguaggggaauggcucuggacucaacguuugcaaaagaaaccagaaggagucccacaucaagguguaagagcaagauauagagagacuccacauauaaauagcgaagguaagaaaagaauagaaaagaaauaugauuuauauaucgauaggucgaugauagaagcugaauuugacgcguuauggagugcacaagcuacauuuaaucccguuguauuucaugcuacagcacacgaaaaauuaaaagauauacuuuuauaucagcgaccgcuuagaccagucaaaccuggaagaugcacauuauuaccagaagaagaacgagcgccucuggccuuaccauccacacaaagauuuagaauuuaucaagaauuaaauaacuuaagacuguuaguugaucaauuaaacgaacagccucuaacgcuugcgcaaagagacacaauagcaacucucauggaggggagagcaaaaauaaguuucgaucaaauaagaaaagcauuaaaacuaggaucaaugacaaaauucaauuuagaagacgacaaaaggaacgaauuaaagggaaaugcaacuggaucucaauuagcaaagaaagaauuuuucggcccagcguggcaccaauuugaugaggcuuuacaagacgauauaguauggcauuuacuaagugaagaaaacgaaagcgcucucauaaguugguuacaagauagaaccggaauagaugcagcgacugcacaagcaguaucgaacgcauccuuaccugaaggcuaugguaguuuaucgagaaaagcacuagaaguuauauuacccagauuacggucugaaguaauaacguaugacaaagcagugcaagcagcaggauuuagccaucauucacaauugggcuuugaguacgauccugaugauguagaagauuggauagaucaugcaacgggagaaguaaaaccaauauuuaaaagauuaccuuauuauggaaaagcacuacaacgccauguagcauuuggaagcgguaaacccgaagauagccaggaaaaacguuaugguaaaauugcuaauccaacgguucacauuggcuuaaaucaaguaagaguaguugcuaaugcauuaauugcaagauauggcagaccuaccgagaucauaauugaauuggcaagagacuuaaaacaaucaagagaacaaagacagcaagaccaaagaagacaagcagauaaucagaaaagaaaugcacguauacgaaauucaauagcacaggcuuuaggaaucgcugaggcccgaguaagacgcgaagacauccaaaaauggauucuaugggaggaacuagauccaggcgacgcuaugcauagaugcuguccauauucuggaguuccaauaucugcaucuauguuauuaucagaacaaguagagauugagcacaucuuaccauucucuaugacucuagacgauucacuuaauaauagaacaguaucauuaagacaagcuaauaggauuaaacgcaauagaaguccaugggaugccagagaagacuucgaagcccaagguuggcauuaugaugggaucuuacaaagagcgggacuuaugccaguacaaaagagguacagauucgcagcagauggauaucaacgaugguuaagggacgaccaagauuuucucgcgagggcacuaaaugacacaagauaccuaucaagaauagccgcggaguacuuaagacuuguuuguccgcaaggaacaagggucauaccagggcaauuaaccgcacuacuucgaagaagauuugggcuaaaugauauacuaggauuagagggagagaaaaacagaaaugaucacagacaucacgcaguagacgcaugcguuauaggaauuaccgaucauggauugaugcaaagauucgcaagagccagugcacaagcaagagaacaaggucugacaaggcuagcagaagaaaugccacugcccuggccuacauauagagaccauguagacagggcggugagcuuaauauggguaagucauaaaccagaccauggacacgaaggagcaaugauggaagaaacagcuuaugggcuaaugaaagauggaaccauaagacaacgccauaaagcugauggaaccaaaggcagggaaguagcaaacguuauaaggauugcggaacccgcucaaccgacuaggcacggaguggaugaccaagguagaccucuuccauauaagggauauauaggcgguucaaauuauugcauugaaauaaccagaggcgcacaagguaaaugggagggaaccguuaucucaacaucggaugcuuauggaauagugcgagcaagaggaauugcaggauuacguaauacaucgcaaggacaaaauggacauccauuaguaaugagauugguaauaggcgauaguuuacgauuacgaaucaacgaugcacuacaaaccaugcgaguaacaaaaauaaguggaaauggucaaguauucauggccgggguucaugaagcaaauguagacgcaagaaauagagauaaaucucaagccuucgcccuaguaaguaaaauggcaggcucacugcaagcagcacaagcccgacaagcaacaaucucuccaauaggggaaauaagagauccaggauuucccggauga

SEQ ID NO: 4936 - RNA, 3120 nt, Artificial Sequence
  Cas9 variant
augaagaaaagaauacucggauuggacauaggaauagcaucggugggaugggcacuuauagaauuugacgacgaguuccaagacaacaaaaagaaaggaacgauuauaaaaaguggcguuagaauauuuacgagagcagaaacgccaaaagaaagagaaccacuugccaaaccaagaagagaagcacgaucucaaagacgaagaauaagcugcagaguagaacgacuaaauuucguacgagaauuauucgugaaaaacggcuuaguugcaaaagaaucugugaauaaaaauaauccaaacaacauuuacaucacgcuaaaucaaauuaaaacaccuuggcaacuaagaauggaagcucucgacaggaaauuaacaaaugaagaguucgccguaguacuaacccaucuagcgaaacauaggggauacaagucacuaagaaaaacggacucaaaagacaacaaaacaggggaaaugcuaaaagcaaucaaccaaaauaaagaaagauuagauaacagcgacuacagaacacuaggagaaauguuuuguaagcaugaaagcuacaaagaacauaaacggaauaaagauggagaauauauuaacagcgucacuagagaauuaauugaagaagaagcagaaaagauauuugccaaacaaagaaaggaagggaauaacuucgcagauguagacaucgaacgagaauaucuuaaaauagcauucucacaaaaaccaacaggaaguauaaacaaaaugguaggcuuuugcacauucgaaaauggugagaaaagagcgccucgugauucuuacuccgcggaauuauuuaaaguccuuaauaccauaaauaauaccacaauuacugacaugaaaacaggggaaacaagaaauuucacaggagcggaaauuaaaaagauaauagaaauaauaaaagacaccaaaggaauaacauacgucaaaaucaagaaagaacugaaauuaggaaguucucaauucaguggaguagauuauagagaaaaugcaaaauccaaaggagaaggugaaauauucguuucaaugaaaacauaccaugaaauaaaaagcaaaauagaaaaacuuagcaaagaaaaauggaauaaauuaaaagaaaauacugaauuacuagauaguauaguaaauauaauagcgaauuucaaagacgaugaaucaauaaagaaagaguuccaaaaauuaaaaauugacgaagacauaauagacguauuauuaaauuuugaauuuaagaaauucauaaaccuuucauucaaagcacuuaggaaaauaauaccguuccaauuucaaggccagaaauacauaacagcuuccauguccguaggcuauagccugaaacaagaagggaucaaaaauaaauuccuaagagugccaagucaagaagaaaacguaaacguuccaguaguagccagagcauucgcacaaacacgaaaaguaauaaaugcuguaauuagagaauauggucaauucgaccaaauuaauauagaacuagcaacagaucucaaaaauaguaaauuugauagaagcaaaauagaaaaagggcaaaaagaguuccaaagccaaaaagauaaaguauuccaagaaguucaagaccuaacaggagaaauuauaccaucaucaucacuccuccuaaaauauagacuauggcgagaacaagacgaaagauguaucuacagcggacggaaaauaucaaggaaagauuuacuagacacaggcuuuuuagauauagaccacauaauacccuacucaaaaaguauggacgauggauucaauaacaaaguauuaugucuggcagaagaaaaccgaaauaagaaaaacgacauaccauucaacuauuaccagcgaaucggaagagacuggaauuuucuaaucucaauaauagccucaaugaaaaauaugaaauacgugaaaaagaaaagauuacuaaaacaagaacuaagugauauugaaauagaauccuuuauagaaagaaacauaaacgacaccagauaugcaacacgauauaucaaaaauuuccuagaaaacaaccuagaguucaaagaaaaugaguucauaaaagcuaaaguacaagcaagacauggaggacuaacaagcguucuaagauacaauuggggcauaagcaaaaacagagaagaaagcuacuugcaccacgcaaaagacgcaauaacgguugcuugcaguacucaaggaaugguacaauauauaucaaacauaagccaaaaauaugaaaauggaaaauacaaaaugaaacaaauaaaagaacgaacagaaaauagaaucccaaaaccuugggauucauuuaaagacgacguagaaagaucuauaaacgacauauucguaucauucgcacccagacauaaaguaacgggaagcgcccauaaagaaacuauauauaguaagaaacaucuagaaaaaggauauguaacuauaaagaaaucgcuagauaaaauuaaacuuucugaccucaaaaacauacccugugaugaaaacugcgauauaauacgaguacuaaaagaacgacuagaaaaauucaaugacgacagucuaaaagcauucgcagauccaguacauaugccaacaaaaugcucaaauaagaaaggaccaauaauaagaucgguaaaaauaaaagaaaacaacaaaacaggaaucgaaguacgcaaaggguuaguagaaagaggugauaugguacgaguagacgucuucauuaaagauaagaaauauuacuuaguuccaauauauguaucagauuuuaaaaacaaagaucuuccaaacaaagccauaguaucaucaaaauccgaaaacgaauggauaaugauugacaaaacguacagcuucaaauuuagcuuauucaaagacgaccuaauaaaaauuaaaaacaagaaaggcgaaauauucggauacuuaggagggguccaccgucucaccggugggauaaauauaaaaagcugcuauaaaccaaaagaaaaagacgguaacauaggaagcaaaugucuauuagacuuuagaaaauuccaaguagggauacuaggagauuacaaugaagugaaacacgagaaaaggaugccagcauauaucaauacuaagaaagacaaagaacacuga

SEQ ID NO: 4937 - RNA, 3123 nt, Artificial Sequence
  Cas9 variant
auggaucgacgggaugcaagggcuaugagaaggagaagggaucgauuucaacaaagacaaagggcucuguuaaaauaucugguugcagacggauuauuuccugaagaugaaggugagcguaaagcacuagcagcuuuagaccccuaugcacuaagagcaagagcauuagaugaagcacuaagccuccaugaauuagggagggcguuauuucauuugaaccaaagaagaggguuuaaaucuaaccgaaaagccgauaggaaggcggacgaugacgcaggaaaaauagcuauaggcguagauagggcaagagaggcaauggcggaaaacggagccaggaccuauggcgaaugguugcauaggaggagagcgagcgcuacugaugcaaaugcuauuccuccuguaagaacaagauuaagaccugaaaguggcgaagaugcaaaaggagauggauaugauuucuauccagguagagaucuacuagaagaggaauuugcagcgauaugggaagcccaagcagcgcaucacccagacguacuuacagaugauguauaugaaagauuauuugaaauaguauuuuaucagagaccuuuaaaagcaccacaaauugggauguguacacuuauagcaggcgauagaagacucccaaaggcacacccacuauuucagagacggcgucuguuagaagaacugaaugcucuaaugauuguacgaccuggagagguagcacaaagauuaacccgugaggagagagauacucuauucuuaaaauuaaaagauagaaacaaaguaucauuugagaguuuacgaaaaacacuaaagcuagaccccgaugcaagauuuaacaaagaaucagaaaauagaacagaauugaaaggagaugaaguagcagccgcuaugggcaguaaaacaagauuugggaauagauggguacauuuaucaaucgaagaacaaugggcagugauagagcgauuaggagauguagaauccgaugcagaagaugcggcguuuagggcaugguuagcugaacgauacgaauuaacgccggagcaaacuagagcgguaacaaaugcaccucuaccucaggguuauggaagauuuggagaaacagcaacaagaaaacuaauagaugcuuugagagauggggagaaagacggcagaguacugguauauagugaagcggugacagcagcaggauuaggacaucauuccgacagaagaaccggugaaguauuugaagaugaagaagguagaccucaacugccauacuaugggguggcacuagaaagacacauuaugccaggcacuggugacccaagcgauucagacgaaaugcgaguagguagauuaacaaauccaacgguacauaucgguuugaaucaacugagacgaauaguaaauagauuaaucagagcuuacggacccccagcagaaauugcaauagaauuagcucgugaacuaaaguuaacagaugaggacaagaaaagaauaaacaaagaaaauaacaguaacagacuagacgcagagagaagaagugaaaaauuauuggcaauaggcaaaccugacacaggagcgaauagagccuuacuaaaauuaugggaagaacuuaauccagcuaauguccuagaucgaagauguauauauucugggguucaaauauccaucgauaugcuauuuucagcagcaguagaagucgaucacauacuaccauucaccgcuacauuagaugacucuaauggcaauaaaauaguguguacuagggaggcuaacagggagaaacgaaaaaggagcccauaugaggcuuggggacauagugcaaggugggaagagauagcggcaagagcugcacaauugccuaggaacaagagauggcgguuugaaccagacgcgauggaaaaauucaaagacgauggaggauuucaagcacgacacuuaaucgacacacaauaucuugcaagauuaaguagagaauauuuagccacacuauauccugauaaaggagaaggaagcggacacauauggguaucuccgggccgcuuaacugaaauggugagaagaaaguuaggacuuaaugaucuacuccccgaucauaacuuugguggaggcgcugaucaagcuaaaaaucgcuuagaucacagacaccacgccauagacgcaguaguaguagcaauaguagauagaggcauguuaaacaggauagcaagagcaucgggacaggaaggagcagagggaagagaaagaauaauaauuccagaaccuugggaaggguuuagagaugaccuaagaacagcaguuaacgcuauaacagucucacauagaacagaucauggaacagcaaguaaagcgggacuacccaaaggaaaagaugcaacagcaggacgcuuacauaaugacacugcauauggauuuacaggagaaucagacgcuaaaggaaauucuaucguuguuagaagaguaccauuaagcagcuuuaaaaagcuagccgacauagauagaguccgagacccagagcuuaaagcagcauuauaucaacauuuagacggucuugaagguaaagcauucgagaaagcaauaggugaguuuggaucacgugaauggcauccuuacgguggugucagaagagugagaguuacagaaccacuaucaguaauaccuauacgagacagaaauggacacauauacaaagguuauaaaggagacaguaauuacagguaugacguuugggaauuaccuggcggcaaauggguaaaugaaguugucaguauguuugacgcacaucaaccaggauggcaaucagcuaucagagcggccaaucccacagcaagaaaagugcugagucuacauagagacgauguacuagcgaucgaaagaaauggagcagaacgagaauuaguaagaguagucaaauucagugaaaaacaauuugcuguagcuccgccuaaugagggaggggcauuaaaagcuagggacgcagacaaaggugacccauuuaaguauucauauccaagcccaaauacauugaaagcauuacgugccagacaagucagaaucgaugaauugggacgaguucuagauccuggauucccggcaagaacuaaacagcgcaaaacucgaaaaccaaacuga

SEQ ID NO: 4938 - RNA, 3132 nt, Artificial Sequence
  Cas9 variant
augcaaagagacaacccgcucgucuauagauuagccuuagaucuuggaucgacaagccuaggaugggcgguauuccgauuagaugcggaaggaucaccuuuggcaauaauaaaagcaggagcaagaauauucagugauggacgaaauccuaaagaugguucaaguuuagcaguuacacgcagagcagcaagagcaaugagaagaagacgagauagauuacuaaagcguaaggcacgaauguugggagcacucgaacgucauggauuuuucccacaagacgaaucagcacgaaaagucuuagaaacacuuaacccguuccuauuaagagcucaaggucuagaaguagcuuuaaaaccagaagaguuugggagagcauuauuucaucucaaccaaagaagagguuuccaaaguaauaggaaaacagacaggaaagauucggauucaggugcacuaaaacaggcaauaggaacauuaagagcgcaaaugcaugaaucaggauguagaacuguaggggaaugguucuggaaaguuaggauggaacauaaaccagaaggagucaaaggacaaggaguuagggcuagauauagggagacaccauucacgacagaugaagggaagaaacgcauagauaaaagauaugacuuauacguugaccgagcaaugguagcacaagaauuugaugcacuaugggcugcucaagcugcauucaauccagcacuauucaacgaagcagccagggcugaacucagggacauacuacuucaucagagaaaauuaagacccgugcaaccuggaaggugcaccuuagucccagaagaaccaagagcguuauuggcacuuaguaguacgcaaagauuucggaucuaucaggaggucaaucauuuaagaguucugcaugaugaacuaagagaagagacauuaacauuagcgcaacgugaucaaauaguugcauuacuugaaaaacaagcaaaagucacuuuuacagcaaugagaaaggcuuuaggauuuuccgcauuauuuaaucucgaagacgcaaaacgugauggguuaaaagguaaugcaacugcagcagcauugucaaagaaagacuuauucggaccuuuaugggcaggguucgggacugcucuacaagaugaaauuguaacacaacuaaugacugaagaaucggaaccuagauuaauugcguggcugcaggaacauacaggcgucgaugaggcuagagcucaagcaauagcaaacacaggcuuaccggaaggauacgguagcuuaggacgaacggcguuggcaagaauaguuccggaauuacaaagggauguaauaacauacgauaaagcaguucaagcugcaggauuugcgcaucacucagauuugggauucucuuuugaacacggugcugaugaaguagaaaggaucggagaacguacaauagcaagcacuggagaaauaaaacccguauuugcauucaaacaauuaccauauuauggacgagcacuccaaagacauguagcauuugcaaaagauaauccaaggaaugaugaggaacgauauggaaaaaucgcuaauccuacaguacauauaggacuaaaccagguaagaguggucguuaaugccuuaaugagaagauaugguagaccagcggaaguaguuauagaauuagccagggauuuaaaacaaaguagggaacaaaaauuggaagcacagcaacgacaggcagauaaucagaaaagaaaugcaagaauuagacgaaguauagcugaaguacuagguauaucagaagaaagaguucgaacacuagauauacaaaaauggaucuuaugggaagaauuaagccaugacgcugcagauagaaggugcccguacucugguguacaaauaucagcuucaauguuacuaggagaaagaguagaaauagaacauauccuuccauuuucuaugacacuagaugauucauuaaauaauaggacaguggcauuaagagaagcaaaccguaucaagagaaacagggcccccugggaagccagagcagauuuugaagcccaagguuggagcuaugaugggauucuacaacgagcagaacguaugccacuacgaaaaagauauagguuugcaccagaugguuaugaacgcuggcuaggagaagauaaagauuuccucgcucgugcacuaaaugauacuagguauuugucaaggguugcagcugaauauuuaaggcuagugugcccaggaucagcgacaaggguaauaccaggacaaaugacagcacuauugagaggaaaauuugguuuaaacgauguacuagguuuagauggugaaaagaauaggaaugaucauaggcaccacgcuguagaugcauguguaauuggaguuacagaucaacggaugaugcaaagguucgcucaagcaaaugcgcaggcaagagaagacggauuaacuagauugguugaagacaugccccuaccuuggcccaccuacagagaucaugucgaacgagcaguucaucauauuuggguuagccauaaaccagaccauggcuuugagggagcaaugauggaggaaacaucguauggaauuuuaagagauggcuccauaaaacaaagaagaaaagcagauggaagcgcaggaagagaaauaaguaaccucaucaggauugccgaaccaggucaaccccaaaggcauggaguagaugcugaaggacgccccuuaccuuacaaaggauacguuggagggagcaacuauugcauugaaauaacaguaaaugauaaagguaaaugggagggacaagucauaaguacguucgaugcguauagaauagucagagaaggcgguuuaagacaacuaagacauccuacacaaggucaaaacgguagggcauuagcuaugagauuaguuauaggggauucaguaagauuagaagcuggggaaggaaguuuacaaacauuaagaguugcaaaaaugucagcagcgggacaaguauuuaugagcgagguuaaccaagcaaauguugaugcaagaaauagaaauggggauuuaccuuauguauccaagauggcaggaaguuuucagaaagcuagagcucgccaaguaacaaucucuccuauaggagaacuaagagauccuggauuuaaaggauga

SEQ ID NO: 4939 - RNA, 3135 nt, Artificial Sequence
  Cas9 variant
augaaauacacauuaggucuagacuugggcuacaacagcauagguugggcaauacuugaaaacgacgaaaacggaagcccgauaaaauuauucaaugcaggaguacauauauucgaaccuucaaucgaagacauagagauagacgggaaaggcaaaaccaaaaaugucaaaagaagagaggccagacucagaaggcgacaacuauucagaaaaacuaaaagacucgaaaaacuccuaaauuuuuucauccaggaaggauuuuuccaaaaucagaaaguauuaauaaacgaucccuucgaacgagcagaauucuuauaucaacuagauaaaaaaagcagaaacccauacauacuacgcagagaagcacuagacaacagacuaagccuagaagaaauagcaagaaucuucuaucauauagcccaacacagaggauucaaaagcacaaaaagagaacuugccgaaaugaauaaagacgaaaaaaaaaaaaaagaagacggaauaauucaaagugaaaucaacacacuaaaggaagaaauaaaaaaaaauaguuguagaacucuaggagaauacuucgccaaacuauuugaaaacggagaaaaaauacggggucgucauacugacagaaaaauguaugaagaagaauuccaaaaaauuuuuaacaaacaaaaggaauucuaccccaauauauucacugacgaauucaaaaaaaaacuauauaaauuaaucuuccaucaacgagaacuuaaaagucaaaaagauaaaguuggcuucugcuccuuagaacgaggaaaaaaaagagcaccacuggcacuacuuguaagucaacgauacagauacaugugcaaaguuaacaaccuaaacgucauagacaccgagacuggagagaaccgagaauuaacaguagaugaaaaaaaaaaacucuacgaaaaacuagaaaacagcgaaaaacuaagcuuuaaagagauuaaaaaaauccugaaccucucugagaaaagauacauauucaaccucgaaaaaagcgaaaaguauauuauaggcaacaaaacaaauguaaaaaugaaaaacaucaucaaagacugggacaacuucgacgaggauaaaaaaaacuuuuuuauaaaugaggcacgcacugugguaaaaauagaaaccuuagaaagacggggaaagaaacuaggacucagugaugaagaaagcaaagaauucagcaaaguaguauucgaagauggauauuuaaacuucaguaaaaaagcaguagaaaaauuauuaccauaccuaaaagaaggaaaaaaggaauacgaagcgauaaaauuagcauauccagaaaauuccguucaaaaugauaaccuaaaagagcuggauuuccuaccaccaauaaaauccaaagaacugaaaaaauacuucgagguacgaaacccaauaguagaaaaagcguuaacagaaacacgauaccuaguuaacuuccuaaucaaaaaauacggcaaaccggaaaccauaaaaaucgaacuugcucgcgaauuaaaacuuucgaacaaacaaaaagagcgaaaacacaaagaaaaccaagaaaaccguaagaaaagagaagaagucauagaaaaacuaaaaaacgacuuaaaaauaucagaaccgacagaaacacaaauccaaaaauaccuuuuggcagaagaaugcgacuguaaaugccccuauacugguagaucuaucucaauggacaguuuauucggagaacacccuuuguucgacauagaacacauaaucccguuugaucgaagccuagacaauucguuccuaaauaaaacucuauguuacagcgaagaaaauagaaaaguaaagcacaacaaaacacccuaugaagccuauuauggaacagagaaaugggaggccauaauugaacgagugaagaaguucaaaagcaacguaagaaacgaaaaauuaagaagguuccaaaugaccaaagaagacguagaaaacuauauacaaaauuuuucaacacaaaaucuaaacgauacaaaauaugcaagcaaauuagccaaaaaauaucucggacuacuauauggaagcauaaacgaagacggcauagauaagaaucguaagagaagaauuuuugcaucaucgggaaagguaacauccacgcuacgauacgcacuagggcuaaauaccauauuaaacgacgaaaacaucaaaacacgcgaagaccauagacaucaugcaauugaugccauaacaauugcauuaacagacaguucuaugauaaaaaaaauaucagaugcuagcaaaagagaaaaaaacauaaauagcuuauucaaagauuuccaagcucccugggaaaauuucagaaaagaagucgaagagauaaucgcaaaaaugaauauaucgauaagaauaaauaaaaaaguauccggacaaauacacgaugaaacauucuauaagaaaccguuuaaagaagaagagaaaagcuauacacaccaacgaaucaaccucgaggaacuaacaauaaaagaugaagacaagaagaagcaaucuuccaaauugaucgacaacauuguagacucuaaaauaagaaauauaauaauaaauagucuuaacggagaaaagccaaagauuagguuuaaggacccaaaagaccacccauacaucauccagaaaaacggaaaaaaaauacaaauacauaaaguaaccauuaaaacaaagcucgaaacauacaaugaaauaggaccagaaaaagcaaaaagauacguaaaaucgagugacagucaccacaucgaaauauucgaagacuuaaaaaccaagaaaugggacggcuacgucguaagccuacuagaagcauacgaacgaaaaaaaaaaaaauuaccaaucguaaacaaaaaccuaggcgaagguaaaaaauuuuuauucagccuagcgaaaggagaaaucauagaacuugacacagaaaauggaaaacgggaacuauucguuguaagaauaaucucggccucaaauaaucaaauuaaguucacaagaaucaacgacucacguaaaaucaccgacauaccagcaacgggccugacagcuugcccauccagcuuaaagaaaagaaacugcaaaaagguagucauaaacauacuaggcgaaaagcacuacaguaacgauuga

SEQ ID NO: 4940 - RNA, 3135 nt, Artificial Sequence
  Cas9 variant
auggcagaaaagaaauuuaaauaccgguugggauuagaccuaggcacaaacaguaucggaugguguaugcuaagacuuaacaaagacaaugaaccagcagcaguuauaaaaucuggagucaggauuuuccacgacggaagaaacgagaaaaccaaagaacccuuagcaguaguuagaagaaacgcucgaagcaucagaagaaaucuagaucgaaaaaucucuagacguaaucaucuuuuaaacacauuggucaaauauuuucuacuuccaagcaaugaaaucgaaagaaaagcccuagcuguacuaaaccccuacgaauuacgaagucgagcaguaaacgaaagauuagaacuauucgaacuaggaagacuacucaugcaccuuucaaaaagaaggggauucaaauccaauagaaaaguagauaaagaggacagcagcggcaaaauuaagccagcaauagagagacuuaaaaacaaaaugcaagaaacgaauaagaaaaccgcaggggaauaccuguauagccucaugcaaaacggaaaaccaguuagagcaagauuaggcagaauugauggaucaaauggcuacgagauauauuuagauagagcacuaauagaagaggaauauaacuuaauuaugaaugaacaaaagaaacaucacaaagaauuaacagacgauaucauaaacgaaaucuuuaacaucauauucuaccaaagaccacuaaagaaacaaauaaucggcaaaugcagucucaccggagaagacacaaaacuaaagaaagcacacguucuagcacaagauuuuaucuuguuacaaaaaguacaagaccuaagaguauucgacgacaaccaacuugaguuccgaccauuaaguaaugaugaaaaagacauaaucaaaagagaauuacgcaaaaagaaagaaguaaguuacgaaaacaucagaaaauuacucaagaaauacuaugaaaacguuaaauaugguauguucucgcaugaaacgcuauauaagaaacuucaagggaacaaaacaaaugcacuuaugucagauaaagaaaucaucggagacagcugguauucacuaucccccgaaguacaguacgauaucauagaggaacuauauuccgacaaagacaaugacgaguuaagcaaacucuauucagaaaaauucaacuuaaaugaaagccaaauaaacggauuguuaaacaaagccaucuauagacuugacagcgguuauauaagauauggcaaaacagcagucacaaauuuaaauucaaucauggacaaagacaauuuaaaccuucaugaugcaagagaagaagcaggauacgaaaaagaaaauaaacaagaugcauccgaauaccuagaguacuacggcaaaguauuaccggacuccgucguugauccucaaauagaaaauccuaaaaacgacgaagaaagauauggaaaaauugcaaacccaacaguacaugccgcucucaaucaacuaagaaaauuaguaaacgaacuaauaaaacuauauggcaaaccagagcaaaucguaauugaacuagcuagagaccucaaaaacucaagaaaagcaaaagauguuaucaauaagaaaauugccgaaaaccgaaaauuaaaugaagaagucgauaaaacauuacaagaauauucagaaaaauacaauacacacauagugaaaaacaaauuaaauagagauaaaguaaaacuauggagggaauuaggaaaagacccauuagaaagaaaaugcauauacaccggagagcaaauaaauauagcaaaacuauuuucugacgaaguccaaauagaacacauagucccauacucuaaaacauuagacgauucauuuaacaacaaaacauuauccaugaaacaagcaaacuacuacaaaggaaauaaaacaccauacgaagcauuuaaagacaguaaagauggauauaacuaugaugacaucauagcgcgggcaaaacuccuaaacaacgacaacaaauuuaaacgguucacaaaagaugcaauggacauauauaauagagauggcaaagauuuuauagcccgacaacuuucggacacacaauaucuauccacacgagcauuaauuuauuuacagagcuuauacgaaaaagcacaccacaguagcauauggacaauaccgggacaacuuacagcauuaauaagaaauuaccuuggucuaaacacccuaauaucaaacgauaaaaauaaaaacagaaaugaucaccgucaccacgcagucgacgcauucguaguagcagucacaaguagaucccuacuacagaaaauaucauaugccgcuucacuccaagaagaccuagacaauagaaauguaaguaguuacagaaacaaacuauuagagaaaaugccugaaccguucccaaacuaccgaaaaucucuagaacuagcuaucgacaacaucaaaacaucacacaaagcugacagaucaauaaguggaaaacuccacgaagauacagcauauggaauaguagaaaacgacgacaaauacaauguuguaacaagauggacuguugacaaauucaaagaacaaaaacacuucgaaacaauaagagacaaugagcucaaagagaucgcauguagugacaaagaacuauucgcaaaaaucguggaaaccagaaaaaucaaaucuauaagaaaacucgccaaagaaaaccccguaauaaaaaucaaagauaaauccggcagagauuauaaagcauuugcaggaggaaacaacauuugcguagaaauauacgaagucgauggagucagaaaaagcgaaguuauccaauuauuugaugcugcacaaaaaggauuuaugccggaauggaugaagaaauacccaaacgguaaacuauugaugagacuauucaaaggcgacguaaucggauuuauagaaaacagaaaauauaauuauuacacaauaaaagggaucucaauagcagaucaaaaccucaaauugcuagccaucaauaaagcagaggggauauucaagaaaggucuuaacauacuauucgauuccaauaauaaaaauagcuuaaacgcaaaacaauucaacauaucaguaacaggaaucguaacuaaaaagaaaacagccgauguaaauuucuggaaaaacagaaaauga

SEQ ID NO: 4941 - RNA, 3135 nt, Artificial Sequence
  Cas9 variant
augcuacacaaaaugcgauacagauuagcuuuagaccuagggucuacuagccuaggaugggcaauggucaggcuuaaugcaaaccaacaaccaugugcaguuauaaaagcuggcguacggauauucucuaauggaaggaacccaaaagacggaaguagucuagcaguaacuagacgagaagcaaggucaaugcguagaagaagagauaggcuauuaaaaagaaaggcccgcaugaugagaacgcuuauugaauacggauucuucccagcuaacgaaacgcaaagaaaggcacucgaaaauuuaaauccuuaugcucuuagagccaagggacuggaugaagcguuaacuccaagugaauuugcuagagcacuauuccacauaaaccaaagaagaggguuuaaaucaaauagaaagacugacaagaaagacucggauaguggcgcgcugaaaacagcaauaaaacaauuacauucaguuuuagacccacaaggaaaugacggcaagccaagaacaguaggagaacuacuauauaagcgauucacagauuuaaguaaacuaccaaaagaucgaacaguacgagcuagguauagacaagacaaaauaguuaaagacgacggaaaaaccaaaauagacaaauauuaugauuuauauauagauagagcaaugauagaacaagaauuugaugccuuauggaagaaacaaucagaauuaaaccccauauuguucaccgaaaaugcuagagcagaccuaaaagacguacugcuauaucaaaggagucuaaaaccaguaaaaccgggcagaugcacauucaugagugaagaagaaagagcaccccucgcauuaccaaguacucaacgguuuagaauguaucaagaaguuaauaaucuccgaauacuuagagagggauuaaaagaagaaucauugacauuacagcagcgagacgauuuaauuaacgcacuagagaaaaacaacaggaggaccuuuacacaaauaaagaaacuauuaggaguagguggaucaguacaauuuaauuuugaagacccuaaaagagaagaacuaaaaggaaauacgaccagcgcaauauuggguaaaagcgaacauuucggggaagcaugguuugcauuuaacgaagcaaaacaagaugcaauaguacuccaauuaauaaaagaagagaaugaagcaaaauuaguacguugguuacaagacgaaacugguauagacgagaaaagagccgaagucauagcaaaugccggauuaccagaagguuacggaucauuaugcauugaagcccuagcacgaauuuuaccugaacuaagaagagauguaguuacauaugacaaagcagugcaagcagcaggauuugaacaccacucaaaauugaauagaaaugaagaaauaccagauauuacauuuaagauugaaucaauagaucgaaauucaggagaaaucaaacaauuucaucuacacaaagaacuacccuauuacggugaauacuuacaacgucauguuggauuugguucaggcaagccagaagacucaauagagaaaagauauggaaaaauagccaacccaacaguccacauaggacuaaaucaaguaaggguaguaguaaaugcacugauuaaaagauacggacauccaucagaaauaauuguggaaguggcaagagauuuaaaacagaguaaagauagaagggacgaagaaaauaaaagacaagcagaaaaucaaaagagaaaugaaagacuaagaaaagacaucgcugacauauuaggaauuucggaggaacgaguccgucgggaugauauagaaaagaugauauuaugggaagaauuaucuuuugauccagcagaccgcagauguccauauucaggcguccaagucucaacaguaaugcuacuaagugacgaaguagaaguagaacauauauuaccauuuucacaaacucuagaugauaguuugaauaacaaaaccguagcgcuaagacaagcuaaccgaauaaaaggcaacagaacaccaugggaagcguucggaacauccaacauaucgggauucgacuacucaggaauauuaacacgagccgaacuaaugccgaaagcgaaaagauauagauuugccgaagauggauaccagagauggcuaaaagaugacgcgggauuccuggcaagagcucuaaacgacaccagacauuugucuaaaauugcaagagaauauaugucauuaauuugcccaaauacacgcguaauucccggacaaaugacagcuaugcucagaagaaauuucggacuuaaugacgugcuugggcugaauggcgagaaaaauagaaaugaucacaggcaucaugcaguagacgccuguguaauagccgugacagaucaaggauuacuacaaagguuugcagcagcaagcgcuagcgcuagggaaagacaacuuaaucgccuaguugagaacaugccucuaccgugggagucauacagagaacauguaagacgagcgauugauggaaucugggucagccacagaccugaucauagccaugaaggugcuaugcauaacgauacugcauacggcuugaggggaaaugggaggguaucguuucacaaaaugguagagggaaaaagagaguauauugaagacaacuuaaaaguaauagaaauaacagacacuaaagcaauagacagacauggauuacucccaaccggaaaaccaagaccauauaagggauauaaaggugacuccaacuacugcauugaaauaguaagaaaugaaaaaggcagaugggaaggugaaauaauaucaacauuugaugcguaccagcuaguucggaaguacgguauaguccaacuaagauauccgguauuaucaguaagugguaagccccuaguaaugaggcuuaucaggaaugacuuugugagauuagaacaugaaggcauaacaagaaccuuaagaguauguaaaaugagagaagacggacaggucgcauuagcagaugugacagaggcaaacguagaugcaaggacuagaaccaaagaaauauguuacgucuuuaaaacaggagggucucuacaaaaggcaaaagcaaggagaauuacaauaaguccaauuggagaauugagggauccaggcuuuaaagaauga

SEQ ID NO: 4942 - RNA, 3138 nt, Artificial Sequence
  Cas9 variant
augcaaaaagaaaaaccauuagcauacagacuagccuuggauuuagguaguacaucucuaggaugggcaguauuaagacuguccgcgccaggagagccaagcgcagucauuagagcagguucaagaauauuuagugacgggagaaauccaaaagauggaagcucgcuagcagugacgagacgagcugcaagggcaaugagaagaagaagagaucggcucuuaaaaagaaaagccagaauguuagcugcguuagaaagacauggauucuucccacaagaugaagcugcaagaaaagcucuagaaaaacuaaacccauauggacuuagggccagaggauuagaaucagcacuaaagccagaagaguucgguagagcucucuuucaucucaaucaaagaagaggauuucaaaguaauagaaaaacggaccgaaaagauucagauucaggggcacuuaaacaggcaauagggacacuaagagcccaaaugcacgaaagugguugucguacaguuggagaaugguucuggaaagugagaauggaaagaaaaccggaagggguaaaaggacaaggcguaagagcaagauauagggaaaccccuuuuacaacagaugaagguaagaaacguauagauaaaagauaugaccuauaugucgauagagcaaugguagcacaagaauuugaugcauuaugggcugcacaagcuacuuucgcaccagcccuauucaaugaagcggcacgugcagaacuaagagacauauuauugcaccaaagaaaauuaagaccuguacagccagggcgauguacuuuaguaccagaagaaccucgagcucuuuuggcauuaccgucaacacaaagauuuagaaucuaucaagaaguaaaccaucuaaggguacuucacgaugaacuaagggaagaagcauuaacuuuagcucagagggaccaaauaguugcauuauuggaaaggcaagcaaagguaacguuuacagcuaugagaaaagcacuaggcuucuccgcauuauuuaaucuugaagacgcaaaaagagauggacuaaaaggcaaugcgacaacagcggcacuaggaaagaaagauuuauuugguccuuuaugggcugguuuugauacagcuuuacaggaugaaauaguaacccaauuaaugacagaagagucagaaccuagacugauagcauggcuccaagaacauacaggaguagaugaggcgagagcucaagcaauagcaaacgcaggauuaccggaaggcuacggaaguuuagggagaacggcuuuagcaagaaucguacccgaacuacaaagagauguuauaaccuaugauaaagcaguucaagcugcuggauuugcacaucauucagaccuuggcuuuucuuuugagcaugacgcagaugaaguagaaagaauaggugaacgcacuauagcgucaacaggugaaauuaaaccuguauuugcauucaaacaauuaccguauuacggccgagcacuacaaaggcacguugcguucgccaaagaaaauccaaggaaugaugaagaaagauaugguaaaauugcaaauccuacuguucacauuggacuaaaucagguaagaguaguaguaaacgcacuaauguguagauauggaagaccgacagaaguagugauagaauuggcacgagaucugaaacaaucuagagaacagaaauuggaggcucagcaaaggcaagcagacaaucaaaaacggaacgcuaggauaagacgaagcauugccgaaguuuuggggauuagcgaagaaagagucagaacacuagacauacaaaaauggauacugugggaagaauugagucaugacgcagcagaucggagauguccauauucaggaguacaaauuucagcaucaauguuauuaggagaaagagucgaaauugaacauauacuuccauuuucuaugacauuagacgauaguuuaaauaaucgaacaguggcauuacgagaagcaaacaggauaaaacgaaauagaacaccaugggaugcaaggacagauuuugaggcccaugguuggucauacgacggaauuuuacaacgcgccgagagaaugccacaaagaaaaagacaccgguuugcaccugauggauaugaaagauggcucggugaagauaaagacuuucuagcucgugcauuaaaugauacaagguauuuaucuagaguagcagcugaguacuuaagauuaguuugcccaggaucugcaacacgaguuauaccaggacagaugacagcucuacuuagaggaaaauucggauuaaaugauguuuugggcuuagauggggagaaaaaccgcaaugaccauagacaucacgcaguagacgccuguguaauaggagucacggaccaaagaaugaugcaaagauuugcgcaggccaaugcccaagcccgagaagauggucucacacgauuaguugaagacaugccucuuccauggccaacauacagggcacauguugagcgagcaguaaggcacauuuggguaagccauaaaccagaucacggcuucgaaggagcuaugauggaagaaacuagcuauggaauacuucgagacggaacaauaaaacaaagacgcaaagcugacggaucagcaggccgagaaaucaguagauuaaucagaauaacagagccaagccaaccgcaacgacaugggguugaugcagaaggaagaccacuuccauauaaaggauaugugggcggaagcaacuauugucuagaaauuaccguuaaugauaaaggaaaaugggaaggucaaguaauaucaacauucgaugcauacaggauugucagagaaggaggauugagacaacuaagacauagcacucaaggacaaaauggacaagcacuugccaugagacuuguuauaggagacucaguaagguuagaagucgacgaacaagaacgcguaaugagaaucguuaagauaaaugguaauaaugggcaggucuucauggccccaguacaugaagcgaauguugaugcaagaaauuccgauaaaaaugaagcauucgcauacacaucaaagauugcaggcagcuuucagaaaacaaaggcaagacaaguuacaaucagucccauuggagaauuaagagauccuggguucaagggauga

SEQ ID NO: 4943 - RNA, 3138 nt, Artificial Sequence
  Cas9 variant
augaaaccaagaaaccugaacuauaucuuaggacuagaucuaggcauagcaucaguuggguggagcguugucgaaauugacgagaaugaauaccccauaagacucauagauguagguguaagaacauuugaacgagcugaagucccuaaaacuggcgaaagccuagcacuagcuaggagacuagcuagguccaccagaagauuaauacgaagaagagcguucagauuauuaaaagcaaaaagacuacuaaaacaccaccaaauagucaaugcagaagaauuaacacagcuaccaaaucaaugcugggaguugagagugaaaggacucgauucacuacucucuaacaccgaaugggcagccguguuacuccaucuacuaaagcauagaggauauuuaagucaacgcaaaaaugaagcacaaaacgcagauaaagaacucggaaaacuccgugaaggaauggacaacaacucaaaacuguuacuagaaaacaauuacagaacuccugcugauauugcagugaaaaaauucgccguagaagaaggacauaugagaaaucaaaggggggcauauacccacaccuucaacagauuagacauccucgcagaaaugcaacuauuauucaaaacacaaagagagcuugguucuacauaugcaaauggugaacuagaacaagcuuuuugugaauuauuauuauggcaaaaacaagcacuaaaccgaagccaaauguuaagucuaguuggaaaauguaccuucgaaaaagaagagaaaagagcagcaaaagcaucauacucugcagaaagauuuguagcaauucaaaaacuacaaaauuuacggauccuagaaaauggagaagaaaggggauuauucgauagcgaguucuccuuacuacuagaaaacgcuuacaacuuaaaaucaggacuuacauauaagcaaguucguaaaauccuaaguuuaagugaaaacgcuauauucaaaggacuaccguauuuaucugaugaccuggaaaaaccagagaaaacacaauucuuagcguucaaauuuuaucaccaacuggcagauaucuuaaaaaacaauggauuuucagaugaauggcaaaagcuaucacaagagccaaccuuacuagacaaacuaggaacagaauuaucacuauguaaagaagaaaaugaauucauagcacaauucaauggagaauugccagaagcaauguuaucuacgcucuucaaccauaccaauuucgacaaauuuauacauauaucauuaaaagcacuuaauaacauacuaccacuaauggaacaagguaaugauuacacaaaagcuuggcguaaaguauacccggaaccaacgaaaaaagaugaaaaaacacucccaccaauuccagcggaugagauuagaaacccgguagucuugagaagccuaagccaggcgagaaaggucauaaaugcgguaaucagacuauacggcucaccugcccgaauacacauagaaacagcccgugaacuaggaaaaucauaugacgaucgccaaaaaauaaaaaagcaacaagacaaaaauucagaugaaagagaccaagcaguaaaaaaauuccucgaagaaugcccuaacuuugcaaacaaaguaaaaggcaaagacauauuaaaaauaagacuauacauaaaccaagauggaaaaugucuauacucggggaaaccacuagauccacauagacuauuggaaauaggauauguugaaauagaccaugcacuaccauuuuccagaacgugggacgauucacaaaacaauaagguccuaguacuagcaaacgaaaaucaaaauaaaggcaaccaaacaccauuugaaugguuagguaaagacgaacaucaaugggcacuguuuguagcacgaguaaacggaugccgauucccauacgcaaaaaaacagaggauacuuacaaaaaaauuagacgaacaagguuucuugaaaagaaacuugaacgauacacgguacguauccgccuacuuaaugaaacacauaaaggaaaaccuacaccuaguuggcaaagggagugauaaaguuuucgcauccaacggccaaguaaccaauuuucuaagacgauguuggggauuagaaaagaaaagagaagaaggugacagacaucacgcacuagacgcaaucguugucgcguguucaacggcuucaaugaggcaaaaaauuacauuauuuaagaaauaccaaagauggaauuuaaaaacuggaaaacauauugaucaagagacaggcgaaauaauaccacuacacuucccagcuccaugggauuucuucagacaagagguuaugaucagaauuuucagugaaaugccacaagaagacuuaauaaugcaacuaccagacaggccgcaagccaaucaugaauuuguacaaccacuauuuguuucucgugccccaucaagaaaaauguccggucagggccaugaagcaaaguugagaucagcuagaaugcuggaagccaccggcaaaucaaucaaaaaagaauuuuuaaccgaucugaccauaaaaaaucuagaacacauggucaacaaagaaagagaaccagaauuauaccaagcauuagucgaacacuucaaaaaauacggagauaaaccuaaagaaaaauuuuuuaaaaaggggggaguagaaguaaaaucaauaagaauaucaaaaacccaaaauaaauccguaaaucuaggaaauaaaacuauugcagauaauggcgacauaguacgcacagacuuauuuuuaaagaacaaaaaguauuacuucguaaacauauaugcauggcaaguuucaaaaggcauacucccuaaggaaacaacaaccggaaacauacuggacaacaguuacgaguuucaauuuucguuauuuaaaaacgacuuauuagaaauaccccauccaaaaaacgagaacgauaguauacuugccuacuuuauacgaccagacgacgaacgaagauggauccuuaaauuccaugauaacgcaaagauacccgauauauaugguaaaaaagacgaaacuucaauuagacucuccauucaaggacaaaaguucauaaaaaaauaccaaguagaugaacucggaaagaauauuagaccaugccgaccuacuaagagacaaggaguacgauga

SEQ ID NO: 4944 - RNA, 3141 nt, Artificial Sequence
  Cas9 variant
augaaaaucuacaguuucgacauaggaguggcaagcauuggaugggcauucauagaaaacgaagucuuacaagauuguggcauacgaaucuucacaaaagcagaaaaccccaaaaacggagcaucucuagcacuaccacgaagagaagcuagaggaguacguaaacgauuagcgcgaagaaggggacgccuaaacacaauaaaacaacuacuguguaaagaauuuggauuacagcuagaagacuacuuaaguaacgauggagaacuuccaaaggcuuauacggcaucaaaagcaaaucccuuaaaaucaccauacgaacuacguacacuagcccuaagccaaaaacucgacuccaaagauuuaguaagagucauccuucauauagccaaacacagaggguacggaaauaaacacgccaaagacucaaaagacacugaaucaggaaaagucaagaaagccauagaauuuaacagaaaaacacuugcagaaaaagguuaucguucaguuggugaauauuuauacagagaguucuuucaacaaagcagaauaucacaaaacaauggcgcaacugaguuugucaacguaagaaauaaaacaggcaauuacgaacacuguguagcucaagacauguugaaagaugaacuagaauuaauauuccgcaaacagaaagaguuaggauuacaccuaucagaugguuuugaaaaacaauuacuugacaaaauauucgaacaacgaccccuaaaguccuucgcugauaaaguaggaaaaugccaauucauugccggugcaaaacgagcucccaaagacucaauuagcgccauagaauuuguugcacuaucaaggauaauaaauacacuagcaaacuuaucaaagaaaucgggagagauguacgauaaagcaaugguacuaacaauccuagauucuguacuagaaaaaggcgagaugaguuacuaugcccugcgcgaagcaauuaaccuagacgagaaaauaagauucgccgacucaagacuugauuacuccaaagaaauaaaagaaacagaaaaagugaaauucguagaaugcaaaaaucuaaaaucuuucaagaaaguauuaggaaauugcuacaaaacccuggagcgaaaacauauagacuccauugcagaacgcauagcgguaauaaaagaugucgaaaaacuucacaaagaacuagaaagcuauugugcuacugaacaauuaucacucacaucggaacaaauccaagcacuaucccauuuaaacuuuucuucacauauaucauuaagccucaaagcauuagaacaaauccuuccauucaugagaggcgaacgagaagcaagaagcucagaugcagacuauugcaucggaaucgacgaaucuggugaaagccaaugccugagauaugacgaaucaguagaaaaagccgggcucaaggcuuuaucaaaagacacgcuaaaaggacaaauauuacccccucuuaaugaguucgaacccuaccuagcaaauccaguaguagcaagagcucuagccgaauauagaaaagucuuaaaugcacuacucaaacaauacggcucaccacacaaaauacauauagaauacgcaagagaggccaaacuaaacacgacagaaagacaaaaauacgaaaaagaacaaaaagacaacuacgccgcaaaccaagcagcacauaagaaaugccaagaacuaggcuuggaacccucuagcacuaauuuacuaaaacuuaaacuguggcaagagcagggaggcuuauguuuauacaguggugcuaaaauuacaauaagcuaccuacaagaccccacagcacuacaaguagaccacauauauccauacucgcgaucauucgacgauagcuauaugaauaaaugccuaguucuaacuaaagcuaaccaagaaaaaggcaauagaacaccuuuugaagcauuuggcacagauagcgcaaaaugggguguaauuacaaccuuagcacaaaaauuaccccauaagaaaagaagaagaauauuaaauacagcauuuaaugacaaagaagcaggcuuuaaauuaagaaaccuaaacgauacuucuuauauugcaagacuuguagcugacuauacagaaaccuacuuagaauuucucucauugguagaaucagagaacacaacauugggaaaaggacaaaaaggaagcaagaaacacaucgcaauagucaacggcgcccuaacaucaacuaugagauacuaccuagguuucgcaucaaaagaucgggacaaccaucugcaccacgcauuagaugcagucauaauagguuucaugaaugacucugugauuaaagcauucuccgacuucaagaaaacucaagaaacaucaaaagcagcauacuaugcacacacauuguccaaacaagaauacaagaaacaaagagcuuuuauccaacuccccucaggggaaaacuuccgagccaacguacuagagaaagcugaaucagucuucguaaguaaaccaccacgaaaaaggguaagaggcgcacuacacgaggagagcuuuuacucucaaaacgacacaaaacuucucaaaaguuacggcggugcagaagguauugaaaaagcauuacaacuaggcaaaauaagacaaauagguacaaaaauaguaucgaacggagcaaugguacgcgucgauauuuucaaacaucgaaaaagcgggaaauucuacggaguacccguauacacaauggauuucgcauuagggauacuaccuaacaaagcuguuguccaaggcaaagacaaaaacgacguaauuaaagauuggcuagaaauggauucuuccuaugaauuuauauuuagucuauacaaagacgaccuacuauuaguacaaaagaaagaaauggcagaaccagaacuuuguuacuuugucucauucgauacaucuggggcuucaauuaaaguugcaaaacacgacaacaauuuuagcacuuuaaccgaaaaucaaaaauuacuuuucucaaaugcaacaaaagaagaaguaguaggaaaaucaauagguauucaaaauuuaaaaguuuuugaaaaauggcaaguaucaguacucggagaaguuaaaagaacucaaaguuauccacgagaaaacauaucacuagcaucaaaagcuaagaaauga

SEQ ID NO: 4945 - RNA, 3144 nt, Artificial Sequence
  Cas9 variant
augaaacucuuacgauauauauuaggacuagaccuaggaauagcaucuguagggugggcaauuguagaaauagacgagaaugauuuuccaauaagauuaauagauauaggcgucagaacuuuugauaaagcugaaguauccaaaacuggagaaucauuggcuuuggcaagaagauuagccagaaguacaagaagauuaauacgaagacgagcauuuagacuucucaaagguaagagacuauuaaaacaacacaacguaauaaauaaggaggcauuaaccacacuaccaacugauuguugggccuugaggguaaaaggacuugacgaaagauuaaguccaaccgaauggagugcgguccuauuacaucuucugaaacaucgaggauaccugucacaaaggaaaaacgaagccaaaagugcagacaaagagaugggagcccuccuuaguggaguagccucaaaccaucaacuccuaguggaaaaccaauuuagaacgccagcagaaauagcuguaaagaaauuugccuuagaagaaggucauauaagaaaucaauugggagcuuauacacauacauuuaauagacuugacuuacuggcagaaaugaaacuacuauuucaaacacaacgagaacuuggaaacccccauacaaguggccaauuagaacaggaauuuugugaacucuuaauguggcagaaaccggcauugaguggagacgcuauuuugaagaugcuagguaaaugcacuuuugaaacuaaugaauauaaagcagccaaacacuccuacacagcagaacguuuuguauggcuaacuaaauuaaacaaucuuagaauacucgaacauggaucagaaagaguacuaaacacagaugaacgaagucuauuauuaaaccaaccauacgaaaaagcgaaacuaacauauacacaaguuagaaaacuacucggacuaucagaagaagcuagauuuaauggugugagauacgguaaagaaaaagcagaagaugcaaccuuaaucgaacuaaaggcuuaucacgcuauaagaaaagccgucgagaaagcagacaaaagcgcaugggaaacuuugaaaaaucaaaccgcauuauuagacgaaaucgguacgacauuuucaauauauaaaacagaugacgauaucacugagcaguuaaauggaaaauugagcgacacaguacuaaacgcuuuauuagagaacuuaaauuuugauaaauucauacaauuaagccuaaaaaguuuauauaacauuguaccuuuaauggaacaaggccuaagauacgacgaagcaugucaacaaauauacggagaccacuuuggaaagaaaucuggagaaauaaacagguuacuaccaccgauuccagcagaugagauacgaaauccaguaguucuacgaucucuaacucaagccagaaaaguaauaaaugcggucauaagauuauacgggagcccugcaagaauacacauagagacggcuagagaacuagguaaaaguuacaaagauagaaaagaaaucgagaaaagacaagaacaaaauagagcugaacgcgaaaaagcgaccgcucaauucaaaacacucuucccuacuuuuauaggggaaccaaaagguaaagauauuuugaugaugcgacucuacgaacaacaaaacggacaaugccuauacaguggaaaaccacuaaaccuaaaucgucuuuuagagaaaggauauguagaaaucgaccacagcuuaccguucucaagaacaugggaugacagucaaaauaauaaaguucuugugcuagcaggcgaaaaccaaaauaaaggaaaucaaacaccuuucgaauggcuaggaaaagaugaacaucaaugggcacuauucguagcacgaguaaacgguugucgauuucccuacgcaaagaaacaacgaauauuaacacaaaaacuagacgaacaggguuuuauugaaagaaaucuaaaugauacuagauauauugcacgcuuucuaguaaauuuuguacgagaaaacuuacauuuaacugggaaaggcaaaaauaggguauucgcaagcaauggacagauaacagcauuucuaagaggaagauggggacuuagcaaaguaagagaggaaucggaccgucaccaugcacuagacgcgguaguaguagcuuguucaaccgucgcaaugcaacagaaaauuacacgguuugucaaauaucaagaaggaaaccuacaaacagcagaaagaauagacagagaaacaggagaaauaauaccauugcauuuucccgacccuuggcauuucuuucgacaagaaguuaugauccgaaucuuuagugaaaacccacaagaagaucuaauaauccaauuaccggaucguccagaagccaaucacgaguucguacaaccuuuguuugucucaaggaugccaacacgaaaaaugagcggucaaggacauauggaaaccauaaaaagugccaaacgacuugaugaaggaauuucagucuccaaaguaccacuaacacaacuaaaacuaaaagacuuagacaauauggucaauagagagcgugaaaaagcauuauacgaggcuuuaaaagcaaggcucaaugccuuuaaugaugacccaacuaaagcauuugcagaaccuuucuauaagaaagguggacaacaaguaaaagcaguuagaguagaacaaguacaaaaauccgguguaguuguaagaaacggaaauggaguagcagauaaugcaucaauggugagagucgauguauucauaaaagggggaaaauauuucuuaguaccuaucuacaccuggcaagucgcaaaaggaauauuaccagaucgggccguuguugcugcuaaagaugaaucugaaugggaacucauggacaaaacagcacaauuccuuuucaguauguuuccaaaugaccuaauucaaguuaaaacaaagaaagaaacauucuuuggcuacuauaauggcuuagaccgagcaacaggugcgauaaaucuaaaagaaccugauucaaauauaaacaaaggcaaaaguggacuccauagaagcauaggagucaaaacagcacucucagucgagaaauaccaaguugacgaauuggguaaaaauauaagaccauguaggcccaguaagcgacaggcaguaagauga

SEQ ID NO: 4946 - RNA, 3147 nt, Artificial Sequence
  Cas9 variant
augaaaagacuaggauuagauauaggaacaaauucgauaggauggugucugauagaagaugauggagauggcaaaggaagaaucaucgauauaggagcaagaaucuucucagacgguagagauccaaaaucuggagcaucuuuggcgguagacaggagagccgcaagagcuaugagacgaagaagagauagguaccuuggcagaagaacagccuuccuaaaagcacuaaaaagauucggacugaugccugcagaugaaagcgcggccaaguuacuugcagacagagacccauaugaauuacgagcaagagcacuagaugagagacuagaaccacacgagaucgggcgagcauuauuucauuugaaucaaagaagaggcuuuaaaucaaauagaaaagcagagagaaaaacaaaagaugcugaagacgggaaaauugcuaauggagccaaagcgcuggaccaggcaauggcagaaaguggcgcugaaacauuaggacaauuucuuucaucacgagauacaaaaagaguaagaaugggaagcgaugcucaaggcuaugacuuuuauccgcaaagaaggcauguagaauaugaguucgacacaauauggagccgacagcaacaacaucauccagcacugcuaacagaagaagcucggaagaaauuacacgacauuuuguucuuucaaaggccccucaaagaacaggaaguagguguauguaccuuuguucauaacgaaugccgacuaccuaaagcacauccacuauuccaagaaaggcgauuauaugaagaaguuaaccaacuagaaauuacaacuccuggagccccgaaucggaaauuaacaauggaugagcgagacgcccuuauauuagaauuaagaaguagaaaagaaagauccuucgauucauuggcaaaaagacugaaauuagcaccuggacagagcuuuaauaaagcuagugaaagucgaacccggcuucguggagaugaaguauaugcaguaauggcccauaagaaaagauucggagauagguggccucaucuagauagagauagacaaugggcuauaauaaaacgaauaauagaagaagaagacccagacaaacuacaugcauuucuuacaggagaauggggacuuacugacgaacaagcguuagcaacagccagagcaccauuaccagaauuauaugggcgccuaggaccaacagcaacggcacgaauauuagaggaauuaaagaaagauguuaucacuuaugaugaagcaguacgacgagcaggauggcaucacagugaugacagaacuggagaaaucuugccacaacuaccuuauuauggagagcuauuaacuagagacauaccaccgggaacacaagacccaaaugaucccccggaacagagauggggaaaaauaacgaauccaaccguucauauaggacuaagacaacuagaaaagcuagugaaugcuauaauaaaaguacacggaagaccugaucaaauugucguagaacuugcuagagaauugaaacuaaaugagaaagacaaagaagaacacaauagaagaauaagaagagacacugcagcagcgcaauuaaggucagcaaaauuacagagugaaggcauacccgauacaggagcuaauaggaugcuuuugcgaauaugggaagaacuuaauccaggagaaguacuggauagacgauguccauauuguggagaaccaguaggaaugagaauguuauuugcuggggaagcagauauagaccacauaauuccauauuccaggucauuagacgacagugcaggaaauaaaguaguagcgcauaggaguuguaacagagcaaaagggaacagaacaccauaugaaaaauggguccaugauccagacaggugggauguaaucucaacacagguagcuagauugcauaaaucaaaacaauggagauuuggcccagacgcuauggcacgggucgaaaaagacgguggauuuauagcccgccaauuaacagauacacaauaucuauccagacuagcaggacgauauuuaagcucacucuaccccacgaaagacgauggaucagucuauguaauaccaggacguaugacagcuaugcuaagaagacgaugggguuuaaauagcuuauuaccagaucauaauuucguagacaaugaacauucaaaugcaccgaaaaauagacuagaccauaggcaccaugccauagaugcagcuguaguggcuguuacgacuagagcacuaaugcaagaaauugcacgaacagccggccgagcggaagauaaagacuuagaccgauuauuugaagauuuaccgcaaccaugggaagguuuuagggaagaguuaggugaaaaauuagucagaguaacugucagccauaaaccggaccauggacgaaaaggucuuccuccuaaaaauagagauguaacagcaggccgacuucacaaugauaccgcauauggccucacuggugacguggcagcagacggaaaaacacccauuguaguccaucgggucccacuuaugucguuaaaaccggcagauauaucggauccagaccgaauaccagauccugcucuaagaucggcacuccauagagcaacagauggacugaguggaaaagcguaugaugccgcacuagcgggauucgcaaaaacucauccucaauuugccggaauaagacgaguacgaguuagagagccacuaacuguaauccccauagcagauagagaugggaggccuuuuaaggcuuauaaaggagaugcaaauagucgaguugauauauggcgaaugccagacggaaaauggcuaucugauguugucacuauguaugaagcacauagaagagaucauucagaccgucggccacauccagcagcuaagaaauuaaugucccuccgacaaaaugauaugauagcaguagaaagagacggggcuccacgacaaaucaugguagugaaacaaauauggcccacacaaauuaaucuaguagaacauaaagaaacagguaacuuaaaagauagacauaguaaugaaacugacccuuuccgcuuuuucgcgccaacggccggcggauuaaagaaaaugaaagcacgacaaguaagaauagacccccuaggaagaauauuugauccagguccaagauga

SEQ ID NO: 4947 - RNA, 3147 nt, Artificial Sequence
  Cas9 variant
auggcgaacauagcugaaaaucuuguauuuggaauagaccuuggcauaggaagcuguggcugggcagugcuaaaucaaaaagcaaaagaugaaaacauaguugccuuaggaucguggugcuuugacguaccagaaacugauaaagaaagaauaccuacaaaccagaucagacgugcaaacagacucuuacggagaguaauaagaagacgacggaauagaauggcagaaauuaggcgguuauucgcaucuaagggaaugcuagauacagcagacccagaugcgcuagcaaaaauaucagcggaucccugggaaaugagggcaaaaggacuagacuaucaguuaacaccgcaagaauuugcaguugcauuaggacauauagcaaaaagaagagguuucaaaucggcggcaaaaagaguaucgaccaaugcaccaucagaagauaguaaaaugcucgcugcgcuagaaaaaacaaaggagcaaagugcccaauauagaacaauaggagaaauguucgcuagagaucccgccuaugccgauagaagaaggaaccgagauggauguuucgacagaacuaugucuagagaagaucuauuuaaagaaacacaaauacucuucgaaucacaaagacgccuaggaaauuuuagugcuaccucugaaaccgaacaagcauuuauagauauagcauuuagacaaaaaccaaugcaagauucugaaagacuaguugaaacuugucuguucgaaccugaugaaaaaagagcuucaagauuugcaccuucauuugaaagguuuagguuauuguguagacuaguaaauuugagaguaacugaugguuuggaagauagaccacuaacaccggaagaauuaagacuugcaugugaagaugcugggaaaacacguaaauugucaguaaagaaaguacgaucuuuaauaggacuacgagaugaucaacgauucacuacuauaccucccgaucaagaacaacacgauauagcggcuagaaccggcgacgcauuaacugguacggccacauuccgagcaauucuaggagaaaguuucuggagacaauuauuaccacacccagaacaacuugacagagcggcauggauaauuuccuuucaugaguuaacagacacaauaauuagcaaguuagcgacgauuggacuaccuucagaaguaauggaacuuauaagaaaagcccuagaagacgggaaguuuaguaaauuuaaaggagcggcaaguuuaucagauaaagccgcaagaaaauuaauaccguuccuacaagaagggcuaacauaugauaaagcuugucagaaggcaggauacaaccaugcagcaaguaaauuuacacacuacgauucaauagauacaaaagcaaaauuuaauucucuaauggacgauguaagagacagcauuacaaacccaguggcaagaaaagcaauaagcgaagguaugaaacaaguaugggcuaugagaaaucaauggggauuaccaggagccauaugcauugaauuagcaagagauguugggaauagugcagaaaaaaggcgagaaauugaaaguggaaucaagaaaaacaccgcucaaagagaacgugagcgacaagaagcuaaagaacaccuuaaccagagugauauaagcagcgaaacucuuuugagauaucgacuauggaaggaacaggguggaagauguuguuacacggaucaaccuauaacuccaucacaacuaauagcaagcgauaacucuguacagguagaccacauauuaccauggucaagauucggagaugauagcuaccugaauaaagcacucugcacagcaaaggcaaaucaagaaaaaaaaaacagaacuccuugggaauggauccacaaccaaaaaggcguagaagccuggaaucauuuuaccgcugcaguggaaagccgaaaagaaacccgaggcuuaaaaaaaaggaauuuucuauuaaaaaguucaaaagaaacagaagaaagguucaggaguagaaauuuaaacgauacacgauaugcagcccggguaauggccgaagcaguaagguuacuguauccaagugggaacagagcugagaagggaggugugaaacgagucuuuaccagacccggagccuuaacugcagcauuacggcaugcuugggggguagaaagcuuaaaaaaaauaaaugguaaaagguuaaacgacgacagacaucacgcucuagacgcagcagugguggcggcgguaucagaaaaagaaauacaaaaauugacaaaaucauuccaaauaugcgaacaaaaagguuuagcgagacccaugcgagauguacccaugccaugggaaggauuccgacaucaauuggaaacggcauaugcagauauucgaguagcacggccagaaagaagaagagcaagaggaaaaggacaugacgccacuauacggcaacuccgagaagaaaaagauggaccaguaguguaugaaagaagagcaauaagugacuuaaaacuaacagauuuagagagaauuaaagauccagagagaaacucagccauaauaagcagcuuaaggacguggauagaaaaggguaaaccagcagacuauccaccgcaaucuccgaaaggagaugaaauaaggaaaauaaggguuaugaguagaaauaaaccggcgguauccguucgaggaggaaccgcugauaggggugaaaugacaaggguggacguauuuacaaagaugggaaaaaaaggcaaaccagaaugguuccuaguaccgauauauaggcaucaaguaauagaucgaauccaauggccucaaccaccaaaccaagcagcagcaaauggcaagagugaaaaaaacuggccuaccaugggacuagaacaugaauuucgauuuucauuguacccuagaucauauguccaaauaguaaaaagagacggcgaaauuauagaaggauauuucgcaggacuggacagaacgguagcagcguuuagucuucuauccaguucagauccgacuucaauacaacgagguauaggagcaaagacauuagaaaguauacggaaauacaacguaaaccgauuuggagauauaagcaugguggaacaagaaacacgaacauggcauggagacguaugcaucagcccggaucaaccggauuccgcauga

SEQ ID NO: 4948 - RNA, 3147 nt, Artificial Sequence
  Cas9 variant
auggucgaaaaaauacuugguauagaccuagggauuagcucacuuggaugggcaguaguagaauaugauaaagauaacgaugagaauaauaaaauaauagacuguggaguaagacuauuuacagccgcggaaaccccaaaagaaaaggagucgccaaauaaagcacgacgugaugccagaggucuaaggagaguuauaaagagacguagaguuagaaugaacacaauaaaaaacuuacuaauuaccuauaaauuaauagacaaaacccucuuagaugaggaaaugggcauguuucauucccaaagcaaccgaguggacguauggaaacuacgccacgaugcgcuauaucaccucuugucaggugacgaacuagcuagaguccuaauccacauagcaaaacacagaggauacaaguucuuaggugacgacgaaagugacgaagaaagugguaaaguuaaaaaagcaggagcagaacugaaaaaaaaauucuuagaagccggaugccagaguguaggugaauggcuuuggaaagaaagaggacuccaaggaaaaaaaaggaacaaaucaggagacuaugaaauuuccauuccacgugacuuccuagucgaagaaauacaaagaauauuugaaacucaacagaaauucggaucuaccuucgcaacaagcgaauuacaaaaagccuauacugacauagcauucuacguaaaaccaaugcaaagcauugaagacaugguaggauauugcaccuucuacccaaaaauaaaaucuaaaaaucaagacggcgaaaaaagagcacccaaagccucaccaagcgcagaacaguuugugauauuaucaaaaaucuuuucaacaauagugauagaugaaaauaaacaagaaaaaaaauuaauagaacuaaaaaguauagaacagcugauacaaauugcccguuccaaagaaacacucaaauacaaacaacuaaggaaagaacuaaacuuagcaaaagacauauccuuuaaaaguauaagugaugaggaaaaaacauggaucaaccuaguaggcaacgcaaaguucaaaaaaauccuaggacuaaacuaugaaacauuccuuaaaaacacagaaauaucagacgaaaucgccaaaauauuaacuuacgauaaaacauucgaacaaaaagaaacaaaacuuaaaaaccuacuaguaaacaucgacuggauagacaauaaccacauagcagaauuagcaaaauuaagcuucucacaauucaaccaacuuuccuuaaaagcuauaaaaaucauaucaaaaauaaugauagaaggauacgcuagauaugacgaagcaguacaauacgcauucgaaaauaaucuacucccaaaaccuucacaugaaaaaucaauacuauugccacccuuaaaagaaacaaacaucgcaauauuaaacccuacgguaauccgugcauuugcacaauuccgucaaguagccaaugcguuaguuaguaaauacggaagcuucgacaaaguacacuucgaacuagcuagagaagucaauaccaaagaagacagaaaaagaugggaaaaagacagagauaaaaaugaaaaaaugcaccgacaaauaacagaaaagcucguugaagaagggguaaaaccgucauacaaaaauauacuaaaaaguaaauuaagaagugaacaaaaagacaccugccccuacugccaaaaaaaucuacauuaucccaugauauuugaagauggcuacgcagaaauagaccauauucuacccuuaagucaaucccaggacgacucauacgucaauaaaguucuaguccacucagcaugcaaccagaacaaaaaaaacagaacaccauucgaaugguuucaagaugaaaaaaaagauugggauacauucaagaguuacaucuuaauggaaagcacacugggagaaaaaaaacgcaacuaccuaaucaaagaaaauuuuucagacccucaaucacguaaagaauuuauaagccgaaaucucaaugacacacgcuacaugucuaaagcaauaaagaccuacugcgaaaaccauuggaaacuaagccaugacgacgacaaacuccgcauacaaguacgaaguggaaaacuaacaagcacacuaaggcaucaauggggacuagacaacaaaaacagagaaacucacacacaucacgcaauggaugcaauuaugauagccuucucaacucaaggaaugguaaaaaaacucagugauuauuuugcaaaaaaagaagcgaaaguugaaaaagauaaaccaguacuaauaaccccaauaaaacaauucaaagaagcaguagaacaagcuacuacuuuagaacgucaagaaaguauacaaacaaaagcuggagacacaauaacacucaaccgacuacuaauaucacgaccuccucgugcuuccguuacaggagccgcacaugaacaaacugccaagcccuacccuagaauaaaaccaaucaaaaauaaauauaaaaggagaagaauaccaaucgaugaagauaaauucgaauuauuuaggaaugauaaaguagcaaguggaaaugacaagaacuuuuacaacagcagcacaauaccaagaguagauauauacaaaaaagacgauaaauaucacguugucccaauauaucuaagugauaugaccaaagcugaaguaccaaacaaaucgcuaggaacaaacccugaaggcauggaugaaaaauacuucuguuucuccgucuuuaaaaaugaccuaauagaauuagaaacuaaagcaacucccaaaaaaccaucuaaaaaacucuuagguuacuucaaacaacucaacggagcuaacuucauacuaaacucaauucauaaugguauaaucgacggcuucguauguagccccauaacacuauuuaaacaacagaaagacaugugcaaaaaaugucuccccgaagacagagccauaggcaacuguucccaggaaacauuagaauucugggaagcagaaaacauaaaaguaccaaaaaaagauuuugaaugcgaccaagguaucaaauuugcuauugcuguuagaaaauacaccauagacccacuaggauacuaucaugaaguaaaaggcgaaaaguuauuaggaacaauaccacagggggcaaaaaaacauccaaaacgacagaaauga

SEQ ID NO: 4949 - RNA, 3150 nt, Artificial Sequence
  Cas9 variant
augauaaaugaaagauugacuuuuggcauagaccuuggcauugggagcugcggaugggcaguccuaagacacgcugaugcagcuggggagccaggaguuauagaaggacugggcucaugguguuucgauguaccagaaacaaguaaagaaagaauaccaacuaaucaagugagaagaucaaaucgauuauuaagacggguaauaaggagaaggagaaaucgaauggcagaaauaagaaggcuauuucacgcacagggauuacuuccgagugcagaugaagaugcauuaaaacguccgagauuagacccaugggaguuaagggcucgcggacuggaccaguguuuaagugcugaagaauuugcuguggcacucggccauauugcaaggcaucgaggauucagaucaucugcuaaacguaaagcugcaaauacaaguggggaagacucuaaaaugcuaucugcucuacuuguuacgagagagaggacugcuagauaucgaacuguaggggaaauguuugcgagagauccagaauacagugcgcgaagaaggaacagagacgguauuuucgauagaacuguagcaagagaugauuuaauacaugaaguaggaaaauuauuugaggcacaaagagcaaggggaagugcauucgcuagcccugacuuggaagcugauuuuaacgcaauugcuuucagacaggcugaaaugcaagacucggaaagacuuguuggaaacugucccuuugaaagagaugaaaaacgagcugcucgaugggccccaucauuugaaagguucagauuauuaacgagauuaauaaacuugagaauagcaacagcagaaggagaacggagauuuaccccagaggauuuggcaaggguaucagccgaacuaggagcuacagcaaaauuaccuguaaguagaguaagggcauuaauaggauuacuaccugaugaacgauucacaacaauuagaguagaagaugaggauagagauauuguagcaagaacaggagaagcagcaccaggaacuuggagacucagaaaaacauuaggugaagcucucugggcagagaugcaggcacgaccugaucaauuagacgcuauagcacacguuuuaaguuucuucgaagcuacagcaaaaauaagguccgaacuggauaggcuuggccugccagcagcaguuauugaagcacucgaucgaggacuggaagauggagcauuugcuaaauuuaagggagcuggucauauuucagcuaaggcaugucguaacuuacugccucauuuacaacaaggacauagauacgaccaggcauguagacucgccgguuaugaucaugccgccaguacucuaucacauacagcacaaguaguuuccaaggcaggauuuaaugcguuaguuacggaacuaggagaaucaaucgcuaauccaauagcuagaaaagcauuaacagaagguuugaaacaaauuagagcuaugugcgcaagauggggauuacccggagcgauacacaucgaacuagcuagagaaguagguaauagcauagagaaaagaagggaacuagaaagucaaagagaaacaacaacaaaaagaagacaaacagaaagagaugaaauaagaggacuguuagccuuagaagauguagaugaugauacauuacucagguauagacuauggaaagaacaaggaggaaaaugucucuauacaggaaaagauauccacgugagacaauuaauagcuacagauaauucuguccaaguugaucauauuuuaccaugguccagauucggagaugauagcuuuaauaauaaaacacuaugcuuagcgagugcaaaccaaagaaaaagaggacaaacaccaugggaaugguuuaguuuaacagguacaccagaagcaugggaaguuuucgcuucccguguugaaacaaguaaagauuuaaggggauuuaagaaaaggaauuugcuucucaaaaaugcagaugaaguugcucaacgguuuagaaguagaaacuuaaaugacacaagauaugccgcuagauuauuagcagaagcggcaaaacuguucuauccagcaggagauaggcaagaaaaagauggacguagaagaguuuugacgagaccuggaccauugacagcagcuuuaagacacgccuggggauuagaguccuuaaagaaagcugaugguaaacguguauccgaugauaggcaucaugccuuagaugcgcuagcuguagcagccauuagcgaaagagaaguacaaagauuaacaaggaguuuccaagaaugggaacaacaagggcuagcucgaccacuaaggcacguggcaccaccauggccuggauuucggggagauguacuagcugcuuacgcucaggcguucgucgcaagaccagaaagaagacgagcuagaggaaaaggacaugaugcaagcauacgccaaguaguaggagaagguccagaagcacaaguauucgagagacggggauuggcugaucuaaaagaagcugaucuagacagaguaaaagauccugagagaaaucaagcuauaauagaagcaguuagagcauggauauuagcaggaagaccagcagaugcaccaccaagauccccaaggggugaugucauugugaaauuaagaacugcuccugcgaagaaaaucaaaccggcaguaccaguccgaggaggaacggcagacaggggagacaugguacguauagauguauuuacaaggccaaacagaaaaggcagagacgaaugguaucuaguuccaauauauccacaucagguaaugaauagaaaagcauggccacacccgccuaugagaaguguaguagcauacaaagaugaagcagguuggacagagauaggagcggaacacucauucagguuuagcuuguauccgagaucauauguacaguuggucaaaaguaacggagauguaauagaaggauauuuagucaguauggacaggaguacuggggcauucagaguguuugugcauaauaauccagcugagauggcaaaaggaauaggugcaaaaacauuauuaaaucuuagaaaauuuaacguggacagguuuggcgugaggacggaaguaaaaagugagguacgaacguggcauggagagguaugcaccucaccuguaccaccagacuga

SEQ ID NO: 4950 - RNA, 3150 nt, Artificial Sequence
  Cas9 variant
augcaacuaucaaaacuaaacuacauuuuaggcuuagaucuaggaauagcuucaguagguuggucugugaucgaaauagaugaaacugaaaugccaauacgauuaaucgauguaggaguaagaacauuugaacgagcagaaguacccaaaacuggugaaucucuggcacuagcuaggcgauuagcaagaucuacaagaagacuuauaagaaggagagcauuuaggcucuuaaaagcaaaaaggcuacuaaagaaucaucaaauaguaagugccgacgaauuaagcacccugccaaaucacuguugggaauuaagaguaaaaggucuagacgaacgacucacaugucaggaaugggcagcaguacuucuccauuuauuaaaacacagaggguauuugagccaaagaaagucggaagcacaaaaugcagacaaagaaaugggagcucuacuuuccggaguagcaaacaaccacaaacuacuuucagaaaaccacuaccgaacacccgcagaaauagccguaaagaaauuugccuuagaagagggacacaugagaaaucaaagaggagcuuauacucauacauuuaacagacucgacuuauuggcagaaaugcguuuacuauuucaaacucagagagaacuagguucaccuuacgcauccggagaacuagaacaagaauuuugcaaacuacugauguggcaaaaaccagcacuuaguggcgacgcaauacuaaaaaugcuaggaaaauguacucuagaacccacagaauauaaagcagcuaaaaauacauauacagcagaaagauucguauggcucacuaaauuaaacaauuuaagaauccuagagaaugguucagaacgagcauuaaaugcagaugaaagggcacuauuacuaaaccaaccauacgaaaaagcaaaauuuacguaugaacaagcaaggaaacuuuuacagcuaaaugaggcagcgagauuuaauagcguucgauauggaaaagaaaaugcagagaaaagcacuuuaauggaaaugaaagccuaucaugcaauucguaaagcaguggaaacagcagacucaucagccugggcaacacuaaaaacacaaccacuucuuuuagacgaaauaggaacugcauuuucaauauauaaaacagaugaagauauaaaaacacaacuacaaggcaaauuagcagacaauguaauagaugucuuacuagaaaauuuaaauuuugauaaauuuauacaauuaucauuaaaagcacucuacaaaauauuaccccuuauggaacaaggacuacgcuacgacgaagcauguucacaaauuuauggugaucauuucggcaagaaagaacagaaaaaugauagacuauuaccccaaauuccugcagaugaaauaagaaacccaguuguauuacgaacgcuaucacaagcccgaaaaguaauaaaugccguaauaaggcucuacggaagcccagcaagaauacacauagaaacagcaagagaacugggcaaauccuauaaagacaggaaagaaauagagaaaagacaagaacaaaaucgagccgaaagggaaaaagcaguagacaaauucaaagaauuauuucccaacuuuaucggagaaccaaaagccaaagacauccuaacuaugcguuuauaugaacaacaaaacggacaaugcuuauauucagggaaaagucuagaucuacaccguuuauuggaaaaagguuacguagaaauagaucacgcucucccuuuuucaagaacaugggacgacucauuuaacaauaaaguucucguauuggcuggugaaaaccaaaacaaaucuaaccaaacaccauucgaauggcuagguaaagaugaacaaaaaugggcacuauuuacagcuagagucaacagcugcagauuuccguauuccaagaaacaacgaauacuaacaaagaaauuagacgaugaagguuuuauacaaagaaaccuaaacgauacuagauacauagcaagguuccucguaaacuuuguuaaugacaaucuacauuuaaccggaaaaggaaaaagacguguguuugccucaaauggacaaauaaccgccuuccugcgagguagauggggacuaacaaaagugcgagaagaaagcgacagacaucacgcacuagacgcaguagugguagcauguaguacaguuucuauacagcagaaaaucacuagguucgugaaauaucaagaagguaaccuacaaacagcagaaagaauagaucgagaaacaggagaaaucauuccauugcauuuuccugauccaugggcauucuuuagagaagaaguuaugauuagaauauuuagugaaaugccacaggaagaccuaguaauaaaacuaccagaucguccacaggcaaaccacgaauuuguacaaccacuuuuugucagcagaaugccuacucgaaaaaugucaggucaaggccauauggaaacaaucaaaucggccaaaagacucgaugaagguauaagugugucaaaaguaccauuaacacaauuaaaacuaaaagaccuagaaaauaugguuaaucgcgauagagaaauugcucucuaugaagcacucaaagcgagacucacagaguuuaaagaugacccugcgaaggccuuugcggaaccauucuauaagaaaggaggaguacaaguaaaaucaguccgaguugaacagguccaaaaguccggaguuguagucagaaacgggaauggcguagcagauaaugcaucaauggucagaguugaugucuuuauaaaagguggaaaauauuuccuugucccaauauacacguggcaaguugcaaaagguauucucccggacagagcaguaauagcauauacaccagagaacgaaugggaacuaauggacgauucagcccaauuucaauuuucaaucuacccaaaugauuuaaucaaauugacuaccaagaaagccaucuuuuucggauauuauucaggauuuaacaggcuaacaggcgcaauuaacaucaaagaacacgaucuccaaauaucaaaaggggacaaaggaguucaucucgguuuaggcguaaaacuagcacuaagccuugaaaaauaccaagucgaugaacuaggcaaaaacauaagaccaugcagacccacacaaaggcaaaacguaagauga

SEQ ID NO: 4951 - RNA, 3153 nt, Artificial Sequence
  Cas9 variant
augaguuccuauagauuuucauuugacuuaggaaccaauucaaucggaugggcuguauucgagcuggacccuaaaacgcgaccaguagcuuuagcagauuguggcguccgaaucuuuccagacggaagaaacccaaaagauaaacaguccuuggcaguagcaagaagagaggcccgagccguuagacgacgaagagaucguuauuuaaaaagaaggucagaauuaauggaaagauuaguagcaaaaggacuaaugccagaaaguagagacgaucaaaaagcauuagaaggacucgaucccuaugcacuacgagcugcaggauuagacgacgcauuaccaccacaccacuuuggcagagccuuauuucaucuaaaucaaagaagaggauuuaaaucuaauagaaaaaccgauaggggagaaaacagugaaacaggaauaacaaaaauaggaaugaagaaauuacaugaggcucuacucagugaaggauguaggacacucggagaauuacaacauaggcaucacgaagcuaaccaaaccccugcaauggacacaaaucccaaaucaguuagaaguaaauuacgcggugagggggcaaaagcuguauaugauuucuauccaucaagggacgcaguagaagaugaauuuaacaaacuaugggacagucagaaaagguuucacccagauuugcuaacagacucagcacgagaugcuauuagagaugcaauauucuaucaaagaaaauuaaaaacaccugacgcuggaagaugcucauuuaauccugcggaagagagaguagcaagagcaaugcccauagcacaacacuuccgaauacuacaauuuguaggcgaucugagauuaauagauaacgaucuaguacgacauccguugaacaaugaucaaaagaaagcucucuacagagauuuacuagcaaaagguaaauugacauuuaaagcaaugaggaaaacaauagguaucggcucagaguacgccuuuucucaugaaagugaaaaacaaucugaguuuagaggagaugaaacagcagcaagacuggcuggaccuaaauacuuuggaccgaaguggagagaacuauccuucaacgaccaaucugaaauaguagacagguuauuacaugaagaaaacgaagaaacuuugauacaauaucuucaagaucgauuuggauuugaucaugaucgaugcgaaguaauagcugacgcacccuugcccgacggacacaccagacucggaaaaacugcucuagaaacauuaguagaaauaaugagagacgaucacuugcccuaugaucaagcaugcaccaaagcaggauacgaacaugcacuaccaccugauggaguaauacuugaugaucuaccauauuauggcaucgcauuagaacgacacguagcauuuggagauggaaaaagugagaauccagagaagagguauggaaagauagcaaauccuacaguacacauagcuuuaaaccaacuacguaagguaaucaaugcuuugauugcaagauauggacacccugaucaagugguaauggaaauugccagagauuuaaaacagucuaaagcaaaaagagaugauauaagcaaagaacagaagaaaaaccaagaccgaaaugaucagcgccgcaagaaacuucaagaggcccauauagcaguuaacgcagaaaauauguuacguaugagacuuugggaagaacuggacgaggauaacgcugcagcaagagcuuguccauuuacuggugaaacaaucucaauggcacgauuauuuucacccgaaguggaaauagaacauauuuuaccuuuuucacgaucacuggauaacaguccggcaaauaaaacucuaugcaugguaugggcaaacagagcaaaagguaaucgcacuccaugggaagcauuuggaagagauagagaaccaggguuugauuggccugaaauugcggcacgagcagcuagauuacccaaaaacaaaaguuggagauuuggcccagaugcuauggaacgauuggagagagaaggagacuuucucgauaggcagcuaacagacacccaauauuugucaagaauagcgagagaauacguaacaaaaauaugugauccaaaucaaguuugggucacaccaggaagauuaacagccugguuaagaaggaacuggggauuaaauggaaucuuaccaacuggaaaugcaacuaaaaauagggacgaucacagacaccacgcaauagaugccauaguagugggguuaacggauagaggaauacuaaauagaguaagcaggucagcagccuuagccgaagcagaagauuuagacagaagcaucgcagaaaugccagauccauuugacggauuccgggauaauauacgacacauauuagaacaaauuaucguuagccauaaacccgaugcaggauuuguaccuggacaucccaagggaaauacgacaccaggagcacuccauaaugauacagcuuauggaauuauaaaaacagaugccaaagguaugucagaaguugucacaagaaaagacguuuugucuuucaaagggacaaaggaaauagaaaguauaagagacgcagcaacgcgacaaagccuauuagaugcagucgcaggaguccccagcgguuuagcauuuaaggaagcauuaagggacuggucaguaagaacagguacaaaacgaguucgaguaacauucaauaugucagugauaccaauacaggaucgagauggaaaagcguauaaaggauacaaaggagauggcaaccuaugcgcagaaauuuaugaacgaccugacggaaaauggggugacgagauaaucucaagauuugaugcaguucaaccgggcuuuacaccccaauggcaacgagaucacccugcggcacaucgcguaaugagacuguucagggaugacaugauaauggcggagauagauggaguuaugacgguauguaggauaguaaaaaugaguccuggaaaaguaguauucacaccacaucacgaagcaaauaccgauaguaggaaucgagacaaagaugacccuuuuucauuccauaccugcuccggagaaaguuuacgcaaaagaaaagcacaaaaacuauuuguagauccacucggaaagauaagagguuauagagcaaaagaaggguga

SEQ ID NO: 4952 - RNA, 3153 nt, Artificial Sequence
  Cas9 variant
augggugaaaauaugauagacgaaucacuuacauucgguauagauuuagguauaggaaguugugguugggcgguacugcgucgaccaucagcauucgggcgaaaagggguaaucgaaggaaugggaucuuggugcuuugaugucccagaaacuagcaaagaaaggacaccaacgaaccaaauacgaagaucaaaucgguuauuaagacggguaauaagaagaagaagaaaucguauggcagcaauacgaaggcuauuacacgcugccggauuauuaccgaguacagauucagaugcuuuaaagagaccaggucacgauccaugggaauuaagagcaagaggacuggauaaaccuuuaaaaccugucgaauuugcaguaguacuagggcacaucgcaaaacgaagaggcuuuaaaucggcugcgaaaagaaaagcaacaaauauaaguucagacgauaagaaaauguuaacagcacuugaagcuacaagagagagacugggaagauauaggacagucggugaaauguuugcaagggauccagauuuugccagcaggcgaagaaacagagaagguaaauacgacagaacaacagcacgagaugaucucgaacacgaggugcaugcacuauuugcagcacaacgaagauuagggcagggauucgcgagcccagaacucgaagaagcauucacagccucagcauuucaucaacguccgaugcaagauucagagcgauuaguaggauuuuguccauuugaaagaacagagaaaagagcagcaaaauugacucccucguuugaaagauucagacuucuugcaagauuauuaaacuuaagaauaacuacaccagacggagaaagaccccuaacuguagaugaaauagcgcuaguaaccagggaucucgguaaaacagcaaaacuaaguauaaaacgagugagaacuuuaauaggcuuagaagacaaucaacgauuuacuacaauaagaccagaagaugaagaucgagauaucguagcgagaacggguggggcgaugacgggaacagcuacccuaagaaaggcuuuaggugaagcauuguggaccgacaugcaggaacggccagaacaauuggacgcaauuguucaagugcuaucauucuucgaagccaaugaaacaauaaccgaaaaauugcgagagauaggauuaacuuuggcuguacuagacguuuuacucacugcucucgaugcuggcguguucgcaaaauucaaaggugcugcacauauaucaacuaaagcugccaggaaccuacuuccacacuuagagcaaggaagacgauaugaugaggcauguacaauggccggguaugaccaugcagcaucuagguuaagccaucacggucaaaucguagccaaaacacaauuuaacgcgcuaguaacagaaauaggagaaaguauugcuaacccaauugcaagaaaagcacuaauugaaggauuaaaacaaauaugggcuaugagaaaucauuggggauuaccuggaucaauacacgucgaauuagcuagagacguaggcaauuccauagaaaaacgacgagaaauagaaaaacacauagagaaaaacacagcauuaagagccagagaaagaagagaaguacaugacuuauuagacuuagaagauguaaauggagauacacuauuaagauauagauuguggaaagaacaaggaggaaaaugccuuuacaccgguaaagcaauacauauacgacaaauagcagcuacagacaauucuguacaaguggaucacauucucccauggaguagguucggugaugauuccuucaacaauaagacucucuguuuagcauccgccaaucaacagaaaaagcgaaguacaccuuaugaaugguuaucaggacaaaccggagacgcauggaaugccuuuguccaacgaauagagaccaauaaagagcuaagggguuuuaagaaaaggaacuaucuauuaaagaaugcaaaagaggcugaagaaaaauucagaucccgaaaccuaaacgacacgcgauaugcagcaagacuauucgcagaagcaguuaaauuauuauaugcguuuggggaaagacaagaaaaagguggaaauagacgaguauuuacaaggccaggagcguugacagcagcauuaagacaagcaugggguguagagucucugaagaaacaagauggaaaaagaauaaacgaugacagacaucacgcauuagacgcccuaacuguugcagcagucgacgaagcagaaauacaaaggcuaaccaaaucauuucacgaaugggaacaacaaggauuaggaagaccacuacgacguguagaacccccaugggagucuuucagggcagauguagaagccacguacccagaagucuuuguugcaaggcccgaaagaagacgagcaagaggggaaggucacgcagcuacaauacgacaaguaaaagaacgagaauguacuccaauaguauuugaacguaaagcuguuagcagccugaaagaagcugauuuagaacguauaaaagacggagaaaggaaugaagcaauagucgaagcaauccgaaguuggauugcaacaggaagaccagcugaugcaccaccgagaagucccagaggugacauaauaacuaaaauaagauuagccacaacuauuaaagcagccguaccgguacgcgggggaacagccggaaggggugaaaugguucgcgcagacguauucaguaaaccaaaucgacgaggaaaagacgaaugguaccuaguacccguauacccacaucaaauuaugaauagaaaagccuggccgaaacccccuaugagaucgauuguagcaaacaaagaugaagaugaauggacagaaguaggucccgagcaccaguuccgauuuagucuuuacccaagaucaaacauagaaauaauaagaccaucaggagaagucauagaggguuauuuuguuggguugcauagaaauacuggugcgcuaacaauaucugcacauaaugauccaaaaagcauacauaguggaauagguaccaaaacgcuguuagcaauuagcaaauaccaaguggaucgcuuuggaagaaagucgccaguccgcaaagaaguuagaacuuggcauggugaagcauguauaagucccacaccgccagguuga

SEQ ID NO: 4953 - RNA, 3153 nt, Artificial Sequence
  Cas9 variant
augaaaauauuagguuuugacauagguauagcaagcauagguugggcauuuguggaaaacggagaacuaaaagauuguggaguaagaauauuuacaaaagcagaaaauccgaaaacaggcgacucauuagcaaugccuagaagagaagcgagaagcguaagacgacgcuuagcacggcgaaaaggacgauuagaaacauuaaaaagacuacuagcaaaagaaugggacuugugcuaugaagauuauauagcagcggacggagaacuaccuaaagccuuuauggguaaaaauuuaaacaacccauauguauuaagauaugaggcacuucaaagauuacuaagcaaagaagaauuagugagaguaguacuccauauagccaaacacagaggauacggaaauaaaaacgcuaaaauuacaaaaagugaagaaagcaaaagagaacaaggaaaaauccucucagcacucgccacuaaugcaucagcaauagcaagauacagaaccguaggggaauauuuuuauaaagaguucugcgaaguuauaaagaacccucaagguuuaucaacaaaugaacauuauacacaauccaaaguacggguauuaaagccaauacggaacaagggaggagaauauaccaauugcauauuacaagaagacuuacaacgcgaacuucgauguaucuuugaauaccaaaaagguuuuggauucccaauaacacaggaguuccaggacaagauacucaaaauagcauucuaucaaagaccacuaaaagacuuuucacauuuaguaggaaaaugcacauucuauccagacgaguucagagcuuuaaaaugcucccuaucagccguagaguucauaacauuaaguaaaacaaucaacguacugacauacaucuccaaagaaucaggagaaguauacucaaaaggucaauacgaacaaauguuagauucaguauucaaagcaguaugcgaaaaaggaucccuauccuucgcccaauuacgaaagauauuacacauagaugaaagaauaagguucaaagaaguagauuauauggcacgcaaaagcaaaaauacaaguggggacaguacacacaaacagaaaacaucaaaucccgaaacaaagaaauuuauagaacacaagaauuuaaagaaauuuugugaaauauuaagcgaaaucgccgaagauagagcccuagcggauucaauagcaagagacaugacgcuuauuaaagacgaagaaaaacuugcccaaaaauuacacggauacgguaaauucucacaagaacaaauaacccaacuaagugccuuaaauuucagucaccacauaaaucuaucauuaaaagcauuaucagaaauuuuacccuuuaugcgcgaaggaaugcgauaugacgaagcauguaaacuugccggcuuaaaagcacgacacaaugacaagaaaucaaaauuucuaccaccauuuugugaaagcauuuaugcagacgaauuaacaaacccaguagugcacagagcuaucgcagaauacaggaaaauuuuaaacgcacuaauagcgaaauacgggucaguacacaaaauacauauugaacucacaagagacguuggcaaaaauuuccaagaaagagaaaaauauaagaaagaaauagaaucaaacuauaaagccagagugcaagcaaugcaagaaugugaaaaacuaggacuaacccucucugaaggaaauauacucaaacuaagauuauuccgagaacaaaacgaaauaugcgucuacucagguaggaaaauaacucuagcaaaucuaaaagaacaaggugcuuuagaaauagaccacauacuacccuauucacguucaagcgacgauucuuauaugaacaaagugcuagucuuuacaaacgaaaaccaaaauaaagguaacaaaacuccauaugaagcauucggaggagauucccaaaaauggggagaaauagaaagccuagcauuaagaaguggauaucccaaaaagaaagccaaaagaauacuagauaaaggauucggcgaucgagaagcaggauucaaaucacguaacauaguagauagcggauauaucgccagacuaauagccaauuauacaaaagaauaucugaaauuuuuaccauuagauucccacgaaaauacagcacuuauagccggugaaaaagauucaaaaauacaugucgaagcaguaaaaggcaugcucaccgcaacuaugagacacuuuugggguuuaggaaguaaaaacagauaugaacauacgcaccaugcaguggaugcaauaauaauagccuacauaaaugccgccaugauacaaagauuuucacaauucagacagaaccaggagagcuuaaaagcacgauucuacgccaaagaacuagcgaaagaagaguucaaaacacaaagagcauucuuugaaccuuuucgcggguuuagagaacaaguccuagcaaaaguaggucaaauauuuguaucaaggccuccaagaaaacgcgcaagaggggccuuacacgaagaaacguuuuacucaauagacgacaagaaacuuagcgaaacguauggaggcaaagaagguguucaacgugcucugagcuuaggaaaaauaagacaaauugguacaaaaauagucgcaaacggaccuaugguacggguagacauuuuuaaacauaaacaaucaaggagguuuuaugcaguaccaauauauacaauggacuucgcauuaggcauccuccccaacaaagccguaguaagcgggaaagacaccaaaagcaaaguaauaaaagacuggcuagaaauggauaguugcuaugaguucugcuucaguuuauucaaagacgaccucauagaaguucaaaaaucagauauggaaaaacccgaacuagcuuacuucguaagccuagaugcuuccgacggaagaaucaagguucgacaccacuguaacgauauaacaaaaauuaacgaaaaucaaaagaaacuguuuucugaagcgauagaaaaagaagucguuggacggggaagcauacaaaacuuaaaaguuuucaagaaauauaaaguaucaccacucggagaaauuaaagaagcuaaauaugaaccucgacaaccaauagcacucaaaaccucaccaaagaaacacaggaaacaaaauaacgcgcaauga

SEQ ID NO: 4954 - RNA, 3156 nt, Artificial Sequence
  Cas9 variant
augaacaauuacauacuaggauuagacauuggcauaaccucuguuggauacggaauagucgauagcgacacaagagaaauuaaagaugcuggaguaagacuauucccagaagcuaacguugauaauaacgaaggccgucgauccaaacgaggagcacggagacuuaaacgcagaagaauccacaggcuagacagaguaaaacacuuacuagcagaauaugaccuguuagaccuaacaaauauuccaaaaucaacaaacccauaccaaacuaggguaaaaggauuaaacgaaaaauuaagcaaagacgaacucguaaucgcauuauuacauauagcaaaaagaaggggcauucauaauguaaacgucaugauggacgacaaugacucaggaaacgagcucagcacaaaagaccaacugaagaaaaaugcaaaagcacugucugacaaauacguaugugaacuucaauuagaaagauucgaacaagauuacaaaguaagaggagagaaaaaccgauuuaaaacugaggacuucguccgggaagcaagaaaacuucuagaaacacaaagcaaauucuucgaaauagaccaaacauuuauuaugagguauauagaauuaauagaaacaagacgagaguacuucgaaggaccaggaaaaggcucacccuucgguugggaagguaacaucaagaaaugguuugaacaaaugaugggacacugcacuuacuuucccgaagaacuccgaagcguaaaauacagcuacagcgcagaacuguucaacgcauugaaugaucuaaacaaucuaguaauaaccagagacgaggacgcaaaauuaaacuauggugaaaaauuucaaauaaucgaaaacguguuuaaacaaaagaaaacacccaaucuaaaacaaauagcaaucgaaauuggaguccacgaaacagaaauaaaaggcuauagaguaaauaaaagcgguaaaccagaguucacucaauucaaacuguaccacgaucugaaaaauauauuuaaagauccaaaauaccuaaacgauauacaauuaauggacaauauagcagaaauaauaacuauauaccaagacgccgaaucuauaauaaaagaacugaaccaacuaccagaauuauuaucagaacgagaaaaagagaaaauaucagcauuaucuggcuacucuggaacacaccgacuaucccuaaaauguauaaaccuacuauuagacgaccucugggaaucaucacucaaccaaauggaauuauuuaccaaacucaaucuaaaaccaaagaaaauagacuuaucucaacaacauaaaauaccaucgaagcuaguagacgauuucauuuuaaguccuguugucaaacgagcauuuauacaaucgauacaggucguaaacgcaauaauagauaaauacggacuaccagaagacauaauaaucgaacuagcuagagaaaacaacucagacgacagacgaaaauuucuuaaucaacuacaaaaacaaaacgaagaaacuagaaaacaaguagaaaaaguauuacgcgaauauggaaaugacaaugcaaaacgaaucguacagaaaauaaaacuucacaauaugcaagagggcaaauguuuauacucacuuaaagauauaccccuagaagacuuacuaagaaauccacaccauuaugagguugaccacauaauaccuagaagcguagccuucgauaauagcaugcacaauaaagucuuaguucgcgccgaugaaaacucaaagaaaggaaaccgcacaccauaccaauaccucaacucaucagaaucaagccuauccuauaaugaauuuaaacaacauauccuaaaccuuagcaaaaccaaagaccggauuacaaagaagaaaagagaauaccuccuagaagaacgagacauaaacaaauucgauguacaaaaagaauuuauaaauagaaaccucgucgacacaagguacgcaacaagagaauuaacuagcuuacucaaagcauauuucucagccaauaacuuagacguaaaaguaaaaacaauaaaugguucauucacaaacuaccuacgaaaaguguggaaauuugacaaagauagaaauaaaggauauaaacaucacgcagaggaugcacuaauaaucgcgaacgcagacuuucuuuuuaaacauaacaaaaagcuaagaaacaucaauaagguauuagacgcaccauccaaagaagucgacaagaaaagaguuacaguacaaagcgaagacgaguauaaccaaauauucgaagacacccaaaaagcacaagccauaaagaaauucgaaauaagaaaauucucacaucguguugacaagaaaccaaauagacaacuaauuaaugauacccuauauucaacacgaaacauagacggaauagaguacguaguugaauccaucaaagacauauauucaguaaauaacgacaaaguaaaaaccaaauuuaagaaagacccucauagauuacuaauguauagaaaugauccacaaaccuuugaaaaauuugagaaaguauuuaaacaauacgaaagcgagaaaaauccauucgcaaaauauuacgaagaaacaggagagaaaauacgaaaauucaguaaaacaggccaagggccuuacauaaacaaaauaaaauaccugcgagaacgguuaggcagacacugugauguuacaaacaaauauauaaauagcagaaauaaaaucguucaacuaaaaaucuacucauaccgauucgauauauaucaauauggaaacaauuacaaaaugauaacaaucuccuacauagacuuagaacagaaaaguaacuacuacuauauaucuagagaaaaauacgaacagaaaaagaaagacaaacaaauagacgacucauacaaauucaucggaucauucuauaaaaacgauaucaucaauuacaacggagaaauguaccgaguaauugguguuaacgacucagagaaaaacaaaauacaacuagacaugauugacauaucuaucaaagacuacauggaacucaauaauauaaagaaaacuggaguaauauacaaaacaauaggaaaaucaacaacucacauugaaaaauacacuacugacauauuaggaaaucuauacaaagcugcacccccgaagaaaccccaacuaauuuucaaauga

SEQ ID NO: 4955 - RNA, 3159 nt, Artificial Sequence
  Cas9 variant
auggaaaauaaaaaucuacauuauauacuagguuuagauuugggaaucgcaaguguaggaugggcuguaguagaaauagacgaaaaagagaaccccuuaagacuaaucgauguaggcguaagaaccuucgaacgagcagaaacacaaaaaggagagagcuuagcuuuaagcagacgauccgcucgaagcgcacgccgguuaacacaaaggagaguagcucgguuaaagaaagcaaaacgcuuacucaaaagugaaaauauuuuguuaagcaccgaugaaaggcugccacaucaaguguggcaauuacgaguagaaggacucgacagaaaacuagaaagacaggaaugggcagcggugcugcuccaucucauaaaacaccguggcuaucuaucgcagagaaagaaugaaucaaaaagugaaaauaaagaacuaggcgcgcuacucucugguguagcaagcaaucaugaauuauuacaacaggcaaccuaucgaacaccggcagagcuagcaguaaagaaauuugaaguagaagaaggacauauuaggaaccaacaaggcgcauauacacauacauucucaagauuagacuuacuagcagaaauggaacuacuuuuuagccgucaacaacacuucggaaauccauuugcaucagaaaaauuauuagaaaauuuaacggcauuauugauguggcaaaaaccagcgcuuaguggagaagauauauuaaaaaugcuagguaaauguaccuuugaagaugaauacaaagcagcuaaaaauaccuauacggcagaaagauuuguauggaucaccaaacuuaauaaucuaagaauacaagaaaauggauuagaaagagcacucagugauaaugagagacuaauguugaucgagcagccuuacgaaaaagcuaaauuaacauaugcccaaguacguucaauacuuaaccugucagacgaugcuauauuuaagggagucagguauucuggggaagauaagaaggcuauagagacaaaaaccaccuuaauggaaaugaaagcauaucaccaaauaaggaaaguacucgaaggaaauaacuuaaaggcagaauggguggcacuaaaagcaaaucccacccuacucgaugaaauagguacagcauuuaguuuauauaaaacagaugaagauauaagugccuaucuagcaggcaaauuaucucaaccaguccuaaacgcacuauuagaaaaucuuucauuugacaaauuuauacaauuaucguuaaaggcuuuauauaaacuucuaccacugaugcaacagggcuugagauacgaugaggcuuguagagaaauauauggggaccacuaugguaagaaaacugaagaaacgcaucauuuccuaccacaaauaccagccgaugaaauacgaaacccaguaguauuacgaaccuuaacccaagcgcgaaaaguuaucaauggagucgucagauuauauggaagcccagccagaauacauauugaaacuggccgcgaaguuggaaaaagcuacaaagacagacaugaacucaagaaaagacaagaagaaaauaggaaacaaagagagaaaacaauuucagaaauaaaaacauuauuuccuaauuucucuggugaaccaaaaggaaaagacaucuuaaaaaugagacuauauuaccaacaaaaugcaaaguguuuauauucuggcaaaccacuagaauuacauagacuauucgaacaaaaauauguugaaguagaucacgcacuaccccuaucacggacaugggaugauagcuuuaauaacaaagugcuaguauuagcuaaugaaaaccaaaacaaagggaaucuaacuccauuugaauggcuagaugguaaaaacaauucugaaagauggagaacauucaaagcccuaguagaaacaucagcauucccuuaugcaaagaaacaaagaauacucagucaaaaauuggaugaaaaaggauuuauagaaagaaaucucaaugauacaagauaugucgcacgauuccuauguaauuuuauagcagauaauaugcacuuaacgggagagggaaaacgaaaaguauuugcaucgaacggacaaauaaccgcucuuuugcgccgacgauggggacucgcgaaaagcagggaagacaaugaccgacaucaugcacucgacgcaguauuaguagcguguaguacuguagcaaugcaacagaaaauuacacgauucgugagauuuaaagcaggagauguauuuacaggagaacgcauagauagagaaaccggcgaaauaaucccacuacauuucccaacacccuggcaauucuuuaaacaggaaguagaaauaagaauauucagcgacaauccuaaauuggaacuagagaaccgauuacccgaccgcccccaagcaaaucacgaguucguacaaccgcuauucgucaguaggaugccuacaagaaaaaugaccggucaaggccacauggaaacuguuaaaucagccaaaagauuaaacgaaggaauaucgaugauuaaaaugccauuaacuaaacucaaacucaaagaccuugaacuaaugguaaauagagaaagagaaaaagauuuauaugacgcguuaaaaaccagauuagaagcauucaacgaugacccggcaaaagcguucgcagaaccauuuaugaagaaaggaggugcaauuguuaaaucuguacgcguagaacaaguacagaaaaguggaguguuaguacgacaaggaaauggagucgcagacaaugcuaguaugguaagaguagacguauuuaccaaagacggaaaauacuuuuuagucccaauauauacguggcaaguggcaaaaggaauacucccaaacaaagcaguuauacaaggcaaagaugaagaagauugggaagacauagacgaugcaacauuucaauucucacuucacccgaacgaccugaucuccguaaaaacaaagaaagaugaauuucuaggauauuucaauggccucaacagacacacaggaggaauaaauauaagaacacaugaccucgaaaaaucaaaaggaaaacagggcauauuugaagguauagggguaaaaauagcacucagcuuugaaaaauaucaaauagaugaacuagggaaaaauauaagacuauguaaaccgucuaagagacaaccaguaagguga

SEQ ID NO: 4956 - RNA, 3159 nt, Artificial Sequence
  Cas9 variant
augaaaaauacgagucuaaacuauguccuaggcuuagauuuaggcauaucaucaguugggugggcaguaguagaaauagaugaaaaagaaaacccauuaucuuuaauagacguugguguaagaacuuuugaacgugcugaaacucaaaaaggcgaaaguuuagcauuagccaggagauuagcgagauccgcaagacgccuaacacaacgcaggguugcaagacucaagaaagccaaaagacuuuuaaaaagugaaaacauacuccuaaguacagacgaaugccuaccucaccaaguuuggcaauuaagaguagaaggacuugaaagaaaacuagaaagacaagaaugggcagcaguauuacuacauuuaauuaaacacagagguuaucuuagccaaaggaaaaaugaaucuaaaucagaaaauaaagaauuaggagcacuuuuaucaggcguagcaaauaaccauaaacugcuacaacagacuacguacagaacaccagcagaauuagccgugaagaaauuugaaguagaagaaggacauauaaggaaucaacaaggaaguuauacacauacauucagucgacuggaccuauuaagcgaaauggaauuauuauuuucuagacaacaacacuuugguaacccuuucacaucagaaaaacuucuugaaaacuuaacggcauuauuaauguggcagaaaccagcacucaguggagaugcaauauuaaaaauguuagggaaauguacauucgagaacgaauacaaagcagccaaacauacauauagugcugaaagauucauauggaucacaaaacucaacaaucuacgaauacaagaaaaugguuuggagagggcauuaaaugauaacgaaagauuggcuuuaaugaaacaaccauaugaaaaagcuaaauuaacuuaugcacaaguaagaucgaucuuaaauuuaagugacgaagcuauauucaagggacuaagauacucaggagaagauaagaaaacauccgaaacaaaaacaguacuaauggaaaugaaagcauaucaucaaauacgacuagcacuagagaaaaaugauuuaaaaacagaaugggcagaacuaaaaguaaacagcuccuuacucgacgaaauagguacagcauucagcuuauacaaaacggaugaagauauaucaaccugccuugccgguaaacuaucacagccaguauugaaugcacuccuugaaaaucucaauuucgacaaauucauccaacuaucucuuaaagcccuacacaaaauuuuaccuuuaaugcaacaaggucuuagauaugacgaagcaugugcagaaauauauggagaucacuauggaaagaaaacugaagaaaaucaucuucuacuuccacagauaccagcugaugaaauuaggaauccuguuguuuuacgaacucucacacaagcacguaaaguaaucaauggugucgugcgacuuuauagcagcccagcuagaauacauauagaaacagguagagaaguaggaaaaaguuaccaagaccguagagaauuagaaaaacgccaagaagaaaacagaaagcagagagaaaaagcuauaagcgagauaaaaacguuauuuccaaacuuuaguggugaaccgaaagcuaaagauauauuaaagaugcguuuguacuaucaacaaaaugcaaaaugccuguacucagggaaaccauuagaauuacacagacugcucgaacaaggauauguagaaauagaccaugcacuaccguuuucgagaacaugggaugauucauucaacaacaaaguauuaguacuggcuaaugaaaaccaaaauaaaggcaaccuaacacccuuugaaugguuggacggcaagaacaauucugaaagauggaaggcauucaaggcuuugguagaaacuagcgcuuuucccuauacaaagaaacaaagaauauuaagucagaaacuugacgaaaaaggcuuuauagaaaggaauuugaaugauacaagguauguagcgcgauuuuuaugcaacuuuaucgcggacaauaugcaccucacaggagaaggaaaacguaaaguauuugccucaaacggacaaauuacagcguuauuacgcggcagauggggccuugcuaaaucaagagaagacaaugaccgccaccacgcauuagaugcgguaguaguagcaugcucaaccguaucaaugcagcagaaaauaacaagauuuguacguuuugaagaaggaaauguauucaccggugagaggaucgacagagagacaggggaaauaaucccacuucauuucccagcaccauggaaauucuuuagagaagaaguugaaaucagaauuuuuagcgauaacccaaaacucgaauuagagaacagguugauagcaagaccgcaagccaaucacgaauuuguucaaccguuauuuguaucaaggaugcccacuaggaaaaugacuggacaaggucauauggagacaauuaaaucagcaaaaagacuaaaugaaggauuaucaguaauaaaaauguuacucacaaaacuaagacuaaaggauuuagaaucaaugguaaauagagaaagagaaaaagaauuauacgaggcucugaaagcaagacuagaggcuuuuaacgaugaaccggcaaaagcauucgcagaaccauucaugaagaaaggcggugccauagugaaaagcguaagaguugaacaaguccaaaaaucuggaguacuuguaagggacggaaacggaguagcagacaaugcgaguaugguaagaguagaugucuucaccaaaggcgguaaauacuuccuugucccaauauauacguggcaaguagcuaaagggauucuaccaaauaaagcggucauccaagggaaaaacgaagaagauugggaagugauggacgaugcaacauuucguuuuagccuacaccaaaaugacuuaguaaaacuuguuacaaagaagaaaacuauauuuggauacuuuaacggacugaaucgagcuacaggcaacauagauauaaaagaacaugaccuagagaaaaguaaaguaaaagacggaauacaccaaaguauaggaauaaaacuagcgcuuagcuuugaaaaauaccagguagaugaacuagguaaaaacauaagauuguguaaaucaucuaaaagacaagcaguaagguga

SEQ ID NO: 4957 - RNA, 3159 nt, Artificial Sequence
  Cas9 variant
augauaggugaacaugucagaggaggauguuuauucgaugaccauuggacaccaaacuggggagcauuucgauuaccuaauacaguacgaacauucacgaaagcagaaaauccgaaagacggaagcagcuuagcagaaccuaggagacaagcaagaggacucaggagaagauuaagaagaaaaacccaaagacuagaagauuuacgaagauuguuggcuaaagaaggaguacugucucucagcgaccuagaaacguuauucagagaaacuccagcaaaagauccuuaccaacuucgggccgaaggauuagacagaccuuugucauuccccgaaugggucagaguucuauaucauaucacgaaacauagaggauuccaaaguaauagaagaaaccccguagaagauggacaagagagaucuagacaagaagaagaaggaaaauuauuaaguggggucggugaaaaugaaagauuauuaagagaaggagguuauaggacagcaggagaaaugcuagcuagagacccaaaauuucaagaucauagaagaaaucgagcaggagauuacagucauacuuuaucacgcagcuuauuauuagaagaagcaagacgauuguuucaaagucagagaacauuaggaaauccacacgccuccucaaaucuugaagaagccuuucugcacuuaguagcuuuucaaaauccuuuugcaucaggagaagacauaagaaauaaagcaggucauugcagccuagaaccggaucaaauaagagcaccacgcagaagugcaagcgcggaaacauuuauguuacuacagaaaaccggaaaucuuagacuaauccauagacguacaggagaagaaagaccuuuaacagauaaagaacgggaacaaauacacuuacuagcuuggaaacaagagaaaguuacgcauaaaacauugagacgccaucucgagauacccgaagaaugguuguuuacaggccucccuuaccauagaaguggugacaaagcagaagaaaaacuguucguacauuuagcugguauucaugaaaucaggaaagcguuagacaaaggaccagaucccgcgguuugggacacguugaggucucgaagggaucucuuagauuccauugcugacacuuuaacauuuuauaaaaacgaagacgaaauacuaccgagauuagaaagccucggacuaucaccagaaaacgcaagagcauuagcaccacuuagcuucagugggacagcacaccugagucuaagcgccuuaggaaaauuauuaccacauuuagaagaaggcaaaucauacacacaagcucgggcagaugcuggauaugcggcaccuccaccagauagacacccuaaauuaccuccauuagaagaagcagacuggagaaauccuguaguauucagggcucuuacucaaacuagaaaaguuguaaaugcauugguucgaagauacgguccaccgugguguauacaucuggaaacugcuagagaacugagucaacccgcaaaaguucgacgaagaauagaaacagaacaacaagcuaaugaaaagaagaaacaacaagcagaaagggaauuuuuagauauaguagguaccgcuccugguccaggugauuugcuuaaaaugcgacuauggcgugaacaaggaggauucugcccguacugugaggaauaccuaaaucccacaagacucgcggaaccaggauaugcagagauggaccauauucuaccauauagcagaagucuugauaacggguggcauaauagaguuuuaguccacggaaaagauaaucgagauaaagguaaucguacgcccuuugaggcauucgggggugacacagcaaggugggacagauuaguagcauggguacaagcgucgcacuuaucagcaccaaagaaaaggaacuuguuacgagaagauuuuggagaagaagcugaacgugaauuaaaagauagaaauuuaacugauacgcgauucauaacgaaaacugcagccacauugcucagagacagauuaacguuucauccggaagcgccaaaagacccaguaaugacacuuaauggaagauuaacagcauuucuaagaaaacaauggggucuacauaaaaaucgcaaaaauggagaccuucaccaugcuuuagacgcagcaguacucgccgucgcaucucgaaguuuuguuuacagacuaucaucacauaaugcagcauggggugaacuaccaagaggaagagaagccgagaauggauucagucucccauaucccgcauuuagaucagaaguauuagcaagauuauguccuacaagagaagaaauacuuuuaagauuagaucaaggagguguuggauacgaugaagcguucagaaauggucuacggcccgucuucgucucuagagcaccaagucgaagacuuagaggaaaagcacacauggaaacacuacgcucaccaaaauggaaagaccauccagaaggcccaagaacagcaucaagaauaccacuuaaagacuuaaaccuagaaaaacuagaaagaaugguaggaaaagaucgagacagaaaacuauacgaggcauugagggaacgauuagcagcauucggaggcaauggaaagaaagccuuuguggcucccuuuagaaaacccugcagauccggagaaggaccacucguacgaagucuaaggauauuugauaguggauacagcggaguagaacuucgagaugguggagaaguauacgcagucgcugaccacgaaaguaugguaagaguugacgucuacgcgaagaaaaaccgcuuuuaucuagugccuguauauguagccgacguagcgcgggguauaguuaaaaauagagcaaucguagcacacaaaucagaagaggaaugggaccuaguagauggaaguuuugauuuuagauuuagcuuauuucccggagaucuaguagaaauugaaaagaaagauggagcguaccucggauauuauaaaucaugucacagaggagauggucgacuuuuauuggaucgacacgaccguaugccucgagaauccgauuguggcacauucuacguaucaacuagaaaagauguacuaaguaugaguaaauaucaaguagauccacuaggagaaauaagguuaguuggaagugaaaaaccuccuuuuguucuuuga

SEQ ID NO: 4958 - RNA, 3162 nt, Artificial Sequence
  Cas9 variant
augaaaagaaacuauauuuugggacucgacauuggcauaacaaguguaggauacgguauuauagacuacgaaacaagagacguuauagaugccggaguaagacuauucaaagaagcaaacguagaaaacaacgaaggaagaaggucuaagagaggcgcaagaagacuaaaaaggagaaggcggcaccguauccaacgagugaaaaaauuauuguuugauuacaaucuacucacagaccacuccgaacuaucgggcaucaauccauaugaagcgcguguuaaaggacuaagccagaaacuaucagaagaagaauucucagcagcccuacuacauuuagcaaaacguagaggcguacacaacgugaacgaaguggaggaagauaccggaaacgaauuauccacaaaagaacaaauaucucguaacuccaaagcguuagaagaaaaguacguagcagaacuacaauuagaacgauuaaaaaaagacggagaaguacgcggaucuauaaaccgauucaaaacaagcgauuauguaaaggaagcaaaacaacuguuaaaaguacaaaaagcuuaccaccaauuagaccaaucauucauagauacauacaucgacuuacuagaaacaagaagaacuuauuacgaaggaccaggagaaggauccccauucggcuggaaagacauaaaagaaugguacgaaaugcuaauggggcacuguaccuacuucccggaagaacuaagaucaguaaaauacgcauacaacgccgaucuguacaaugcacuaaaugaucuaaacaaucuaguaauaacacgugacgaaaaugaaaaacuagaauacuaugaaaaauuccagauaaucgaaaauguauuuaaacaaaaaaaaaaaccaacacuaaaacaaauagcuaaagaaauacuaguuaaugaggaagacauaaaaggauacagagucaccuccacaggcaaaccagaauucacgaaccuaaaaguauaccacgacaucaaagacauaacagcaagaaaagaaauaauagaaaaugcagaacuacucgaccaaauugcaaaaauccuaacaauauaccaaaguagcgaagacauacaagaagaacugaccaauuuaaacagugagcuaacacaggaagaaaucgaacaaauaucaaaucuuaaaggauacacuggcacccauaaucugucucucaaggcaaucaaccuaauccuagaugaacuuuggcauacaaaugacaaucaaauagcgauauucaaccgauuaaaacuaguaccaaaaaaaguggaccuaagccaacaaaaggaaauacccacaacacuaguugacgacuuuauauuaucaccuguaguaaaaagaucuuucauacagucgauaaaaguaauuaaugccaucauaaagaaauacggauuacccaacgauaucaucaucgaacuugcgagagaaaaaaacucuaaagacgcacaaaaaaugaucaacgaaaugcaaaaacgaaacagacaaaccaacgaacguauagaagaaaucauacgcacaacagguaaagaaaacgcuaaauaccucauagagaaaauaaaacuucaugacaugcaagaaggcaaaugucuauacuccuuagaagccaucccucuagaagaucuacuuaauaaccccuucaacuacgaaguagaccacauaaucccuagaagcguaaguuuugacaauuccuuuaauaauaaaguacugguaaaacaagaagaaaauaguaaaaaaggcaacagaacuccauuucaauaccucuccagcagugacaguaaaaucucauaugaaacauucaaaaagcacauucuaaacuuagcaaaaggaaaaggaagaauaucaaaaacaaaaaaagaauaccuccuagaagaaagagacaucaaucgauucaguguccagaaagauuucauaaauagaaaccuaguagacacacgauacgcaacacgcggacuaaugaaccuccucagaagcuacuucagaguaaauaauuuagacgucaaaguaaaaucaauaaauggcggcuucacuagcuucuuaagaagaaaauggaaauuuaaaaaagaacggaacaaaggauacaaacaccaugcugaggaugcccuaauaauagccaacgccgacuucaucuuuaaggaauggaaaaaauuagacaaagcuaaaaaaguuauggaaaaccaaauguucgaagagaaacaggcagaaaguaugccagaaauagagacagaacaagaauacaaagaaaucuuuauaacaccacaccaaauaaaacacauuaaagacuucaaagacuacaaauauucccacaggguagacaaaaaaccaaacagagaacucauaaaugauacauuauacagcaccagaaaagacgacaaaggaaauacacuaaucguaaacaaccuaaauggauuauacgauaaagauaacgauaaacuaaaaaaacucauuaacaaaucuccagaaaagcuacuaauguaccaucaugacccacagacauaucaaaaacuaaaauuaauaauggaacaauacggcgacgaaaagaauccacuauacaaauauuaugaagagacaggaaauuaccuaacgaaauauagcaaaaaagacaauggacccguaauaaaaaaaauaaaauauuacggaaacaaacuaaaugcacaccuagacauaacggacgauuauccaaauagcagaaacaaaguaguaaaacuaucacuaaaaccuuacagauuugacguuuaccucgacaauggagucuacaaauuuguaacagucaagaaucuagacguaauaaaaaaagaaaacuacuaugaaguaaacucaaaaugcuaugaagaagcaaaaaaauuaaaaaaaauaagcaaccaagccgaguuuauagcaaguuucuacaauaaugaccuaauaaaaauaaacggagaauuauacagaguaauaggagucaacaaugaucuacuuaaucgaauagaagucaauaugauagacauaacuuacagagaguaccuagaaaauaugaacgacaaacgacccccuagaauuauaaaaacuauugcaagcaaaacacaaagcaucaaaaaguauucaacagacauacucggcaaucucuacgagguaaagucaaagaaacacccccaaaucauaaaaaaaggcuga

SEQ ID NO: 4959 - RNA, 3162 nt, Artificial Sequence
  Cas9 variant
augaaaagaaacuacauucuuggacucgauauaggaaucacaaguguuggcuacgggauaauagacuaugaaacucgcaaugugauagacgccggaguacgguuauuuaaagaagcaaacguagaaaacaaugaaggaagacgaagcaaaagaggaacaagaagacuaaaaaggaggagacgccacagacuccaaagaguaaaaaaauuauuauuugaccauaauuucuugacagacaacucagaguuaaguggaauaucaccauaugaggcacgagucaaaggucucaaucaaaaaauaucggaagaagaauucucaguagcacuguugcaucuugccaaacgaagagggguacauaacguuaacgaaguagaagaagacacaggcaaugaacuuaguacuaaagaacaaauaucccgaaacucgaaagcccuagaagaaaaauauguagcagaauuacaacuagaaagauuaaaaguagauggagaaguacgcggagcgguuaaucgauucaagacaagcgacuacgugaaagaagcucaacaaauauuaaaaguacagaaagcauaucaucaauucgaccaaagcuucauagacacauauaucgaccuacuagaaacacgaagaacguacuacgaaggaccgggagagggaucacccuucgguuggaaagacauuaaagaaugguacgaaauguuaaugggacaaugcacauacuuccccgaagagcugagaagcguuaaauacgccuauaaugcagaccuuuacaacgcacuaaacgaccugaauaaucuaguuauagcaagagacgaaaacgaaaagcuugaauauuaugaaaaauuccagaucauagaaaacguguucaagcaaaaaaaaaaaccaacucuuaaacaaauagccaaagaaauacucguaaaugaggaagauauaaaggguuauagaguaacauccacaggaaaaccggaauucacuaauuucaaaguauaccaugacauaaaaucaauaaccaguagaaaagagauacucgagaacgccgaauugcuaaaccaaauagcaaaaauacuuaccauuuaccaaucauccgaggacauacaaggagaacuagcacgacuauacucggaauuaacccaagaagaaaucgaacaaauaagcaaacuagccggauacacaggcacccacagacuaucauuaaaagcaauaaaccugaucauagacgaacuauggcacacaagcgacaaucaaauggaaauauuuaauagauuaaagcuagucccaaaaaaaguugacuuaucacaacaaaaagaaauaccaaccacucuagucgaugacuucauauuaucuccuguuguaaaaaggaguuucauacaaagcauuaaagucauaaacgcaauaauaaaaaaauaugguuuccccaaugacauaaucaucgaacuagcaagagaaaaaaauaguaaagacgcacaaaaauucaucaaugaaaugcaaaagaggaacagacaaacaaaugagagaauagaagagauaauaagaacuacaggaaaagaaaaugccaaauaccucauagagaaaauaaaauuacacgacaugcaagagggcaaauguuuauacucucucgaagcaauaccacuagaagaucuacuaaacaaucccuuuaauuaugagguagaucacauaauuccgagaucuguauccuuugauaauucauuuaacaauaaaguucuaguaaaacaagaagaaaacucaaaaaaaggaaauagaacaccguuccaauacuucucauccucagauucaaaaauaaguuacgaaauauucaaaaaacacauccucaauuuagcaaaaggaaaagggcgcauaucaaaaaaaaaaaaagaguacuuacuagaagaaagggacauaaauagauucucaguacaaaaauacuucauaaacagaaaucuuguagauacccgcuacgcaacaagagaacucaugaaccuacuuaggagcuauuuccgaguaaaugaucuugauauuaaaguaaaaaguauaaauggaggcuucacaagcuucuuacguaagaaauggaaauucaaaaaagaacgcaacaaaggauacaaacaccaugcugaagacgcacuaauaauagcuaacgcagacuuuaucuuuaaagaauggaaaaaacuagacaaaacaaacaaaguuauggaagaucaaauagucgaagaacaacaagcagagucaaugcccgagauagaaacagaacaagaauauaaagaaauuuucauaacuccacaccagauucaagauauuaaggacuucaaagauuauaaauauucacacagaguagacaagaaaccaaacagagaacuuguaaacgauacccuguacucaacaagaaaagacgacaaggggaacacgcuuauaguuaauaacuuaaaaggucucuaugacaaagacaacgacaaacugaaaaaacugauaaacaaaucacccgaaaaacuacuuauguaucaucaugacccacaaacauaucaaaaacucaaaguaaucauggaacaguauucuaaugaaaaaaacccguuauacaaauaccaugaagaaaccggaaacuaucuuacaaaauauucaaaaaaagauaacggaccaguaauaaaaaaaauuaaauauuacggcaacaaauuaaauguguaccuagacauaacacgggauuacuuaaaaucaaggaacaaaauaguaaaacuaagcuuaaaaccauaccgcuucgaugucuacuuagacaauggagucuacaaauuuguuacaguaaaaaauuuagacauaauuaagaaagaagauuauuaugaaguagacuccgauucauacgaagaagcaaagauagucaagaaaguuucugaacaagcacaauucguagcaagcuucuauaacaacgaccuuauaaaaguugauggcgaacuauucagaguaauuggcguaaacaaugacuuacuaaacagaauagaaguaaauaugguagacauuacauauaaggaauaucuagagaacaucaaugacaaaaaaucaagccgaaucauaaaaacaaucaguucuaaaacacaaaguauaaaaaaauacagcacugacauuuuaggaaauuuauacgaagcaaaauccaaacaaagaccacaaaugacaaugaaagguuga

SEQ ID NO: 4960 - RNA, 3162 nt, Artificial Sequence
  Cas9 variant
augaaaagaaacuauauacucggucuagauauaggaauaacaucaguugguuacggaaucauugacuacgaaacaagagacguaauugacgccgguguaaggcuauuuaaagaagcaaauguagaaaauaaugaaggaagaagaaguaaaagaggugccggccgucuuaaaagaagacgucgacaccgucuacagcgcguaaaaaaacuucuauucgauuacaaccuauuaacugaccauucagaacucucaggcaucaacccauacgaagcaagagucaaaggccuaucacaaaaacuauccgaagaagaauuuagcgcagcccuauuacaccucgcaaaaagaagagguguacauaauguaaacgaaguagaggaagacacggguaaugaacuaaguacaaaagaacaaaucucccgaaauagcaaagcacuugaagaaaaguaugucgcagaauuacaauuagaaaggcuaaaaaccgauggugaaguacguggaagcauaaauagauucaaaacauccgacuaugucaaagaagcaaaacaauuacuaaaaguacaaaaagaauaucaccaauuagaccaaucauucauagacacauacauagaucuauuagaaacuagacgaacauacuacgaagguccaggcgaaggaucaccauuuggguggaaggacauaaaagaaugguacgaaaugcucaugggacacugcaccuauuucccggaagaacucagauccguaaaauaugccuacaacgcagaccuuuauaaugcacuaaacgaccuuaacaacuuaguaauagcaagagaugaaaacgagaaauuagaauauuacgaaaaauuccaaauaauagaaaacgucuuuaaacaaaaaaaaaaaccuacguuaaaacaaauagaaaaagagauauuaguaaacgaagaagauaucaaaggauacagaguaacgucaacaggaaaacccgaauucaguaaccucaaaguauaccacgauauaaaagacauaacagcaagaaaagaaauaauugagaacgcagaacugcuagaccaaauagccgaaauacuaacgauauaucaaucaucugaggauauccaagaagaacucgucaaauuaaauucagaacuaacacaagaagaaauagaacagauaaguaacuuaaaagguuauacgggaacucauaaccuaucauugaaagcuauaaaucuaauauuagaugaauuauggcauacaaacgacaaccaaauggcaauauucaacagacuaaaacuuguaccaaaaaaaguagaccuaagccaacaaaaagaaaucccaacuacucucguagaugacuucauacuauccccaguagucaaaagaagcuucauacaaagcauaaaaguaauaaacgccauuauaaagaaauacggccuuccaaaugacaucaucaucgaacuagcaagagaaaaaaauucuaaagaugcccaaaaaaugaucaaugaaaugcaaaaacguaaucgacagaccaaugagagaauagaagaaauaauaaggaccacuggaaaagaaaacgcaaaauaccugauagaaaaaaucaaacuacacgacaugcaagaaggcaaaugcuuauauucucuagaagccauaccgcuagaggacuuauuaaacaauccauuuaacuacgaaguugaucauaucauaccgaggucaguuaguuucgacaacucguucaacaauaaaguccuagucaaacaagaagagaacaguaaaaaaggaaaccgaacaccuuuucaguaucucagcuccucagauucaaaaauaucauaugaaaccuuuaaaaaacacauacuaaauuuagcaaaaggaaaaggacgaauaucaaaaaccaaaaaagaauaucuucuugaagaaagagauaucaacagauuuaguguacagaaagauuucauuaaucgaaaccuaguggacacgcgauaugcgaccagagaacucaugaaccuauuaagaaguuacuuuagaguaaacaacuuagauguaaaaguaaaaucaauaaacggcggauuuacaucauuccuucgaagaaaauggaaauucaaaaaagagcgaaauaaaggauacaaacaccacgcagaagacgcacuaauaauagcaaaugcagacuucauauuuaaagaauggaaaaaauuagacaaagcaaagaaaguuauggaaaaucagaccguagaagaaaaacaagcagaaaguaugagcgaaauagaaacagaacaagaauauaaagagaucuucauaacaccucaccaaauccaacacauuaaagauuucaaagauuacaaauacucacauagaguagacaaaaaaccaaauagagaacucauaaaugacacacucuacucaacaaggaaagacgacaaaggaaauacacuuaucguaaacaacuugaaugguuuguaucacaaagacaacgacaaacuaaaaaaacuaaugaauaaaucaccagagaaacuacuaauguaccaucacgacccacagacauaccaaaaacuaaaauuaauaauggaacaauacggagaugaaaaaaauccacucuacaaauauuacgaggaaacaggaaacuauuuaacaaaauauucaaaaaaagacaacggaccaguaaucaaaaagaucaaauauuacggaaacaaacuaaacgcgcaccuagacauaacagacgacuacccuaacucacguaauaaagucguaaaacuuucacuaaaaccauauagauucgauguauaucucgauaacggagucuacaaguuuguuaccguuaaaaaccuaaacgucaucaaaaaagaaaauuauuaugaagugaacaguaaauguuacgaaaaagccaaaaaacugaaaaaaauaucggaccaagccgaauuuauagcauccuuuuauaacaacgauuuaauaaagauagauggcgaacuauaucgagucauaggaguaaauacagacuuaaucaaccgcaucgaagucaacaugguagacaucacauacagagaauaccucgaaaauaugaacgacaaaagaucgcccagaaucuuuaaaacaauagcaucaaaaacacaauccauuaaaaaauauucuacagacauucuaggaacuuuauaugaaguaaacucaaaaaaacacccucaaaugauaaugaaaggauga

SEQ ID NO: 4961 - RNA, 3162 nt, Artificial Sequence
  Cas9 variant
augaguggaaugguuuucgguauagauuuaggaauagcaaguuguggcugggcugugcuaagacaaccacaaagagauggcgaccccggcgagauaguagacuuaggaaguuggauguuugauguaccagagacugauaaagaaagaacaccuacaaaccaaguucgcagaggcaaccguuuguuaagaaggguaauaagaagaagggcgcaaaggaugguggagauuagaagacuuuuccaugaccauggacuauuagcuggacacgcaccugaagcacugaaaagagcagguuuggauccuugggaccuuagagccaggucgcuagacaaagucuuggagccagcugcccuagcgguagcuuuaggacauaucgcgaaaaggaggggauucaaauccgcagcaagaaggaaagaagcuaauacagccggagaugaucagaaaauguuaaaggcuuuggaggccacacaugaaagacuuggaagauauagaacaauuggagagauguucgccagagacccagauuuugagucaagaaaaagaaaucgagauggaauguuugacagaacacaaggucgagaugauuuauuacaugaaguaggcgaaaucuuuaaagcacaaaggaggcucggcagugcauuagcaacugcugaauuggaacaggcuuucacagcaauagccuuuagacaauuaccaauacaagauucagaacggcuaguaggguugugucaauuugagccaaaagaaaagcgagcagcacgauucgcaccaaguuuugaaagauuuagguuguuacaacgauugacaaauuugagaguaguaacaguugaaggagaaagacccuuaacugcugaugaaauagcagcggcagcagcagaucuaggucgaacugcaaaauuauccguaaaagaaguacguaaacgaauuggauuagcagcagaucacagauucgcggcuuuuaaagcagaugaagaagauagagacauuauagcaagaacaggagaggcacuacacgggacauaucgauugagaaaggcauuaggggaagguuuaugggcggaaauguuaccaggacaacuugaugcaauugcacaugcacuuagcuucuuugagacacaagaugugauuuuaaaagaauuagacaaacuagauuugcccgccggcgucagagaugcaauugccacaggcuuagaugcgggagcauuugcaagauuuaaagggacaggccacauaucagcacgugcggccagagcuuuacugccgcaucuggaagcaggacugagauaugaucaagcgugcacaaaagcagguuaugaccaugccgcuucaagaugggcaaaacgugaacagguagccgacaaagcagcauuuaacagauuaguaacggacaugggugcugaaauagcgaauccuauagcaagaaagagcuuaacggaagcauugaaacagcugugggcgaugagaaauagauggggacuuccggaugcuauacauauagaauuggcaagggauguugguaacucguuggagaaaagaagagaaaucgaaagagcaauugagaaaaacacugcagcgagagaaagagaaagaggagaagcgagagaccuacuuggcauugaugaugucaguggcgauacucuccuaagauauagacuauggaaggaacaggcaggcagauguccauauacggaugcaccaaucccaccaggagcaauaauagcaaccgauaacaguuuucaaguggaucacauauuacccuggaguagauuuggugaugauaguuuugcaaauaaaguacuaugugcaacagcagccaaucaaagaaagaaaggacaaacaccuugugaauggauaacugcagcucaaggggaagaagggugggccacauuuguagcuagaauagaaggcaaugcugcauucaggggaccuaagaaaaggaacuauguauuaaagaacgcgaaagaagccgaagaaagauuuagggcgagaaauuuaaaugauacaagauacgcagcaagacuauuggcugaggcaguaaaauuauucuauccagaaggugaaaggcaggacaaagguggaguaaggcgaguuuucaccagaccaggaggacuaacagcggcccuuagacaugcauggggcguugaggcuuuaaagaaaagagacgguaagcguguagaugacgcucgacaccacgcguuagacgcuuuaguagucgcagcuauaggagaaggugaaguucaaagacuaacaagaucauaucaagaaugggaacaacaaggauuagcuaggccauuaagacgaguagauccaccauggggagauuuccauagcuucagacgcgaaguuaaagaugccuacgauggaauuuuuguugcaagaccagaaagaagacgagcgagaggugaaggccacgcagccacgauaaggcaaguacgagaacgagauggggcagccgucguuuuugaacggaaagcaaucgcagaccugagugagaaaagacucgcagauauaaaggacccagaaagaaaucaagcgauuguugaagcuauacgacaauggauaguagacggaagaccagcagauagauuaccgagaaguccagccggugaugaaauaaggaaaguuagauuacgaacuaaaggaaaaccggcaguacaaguacgaggaggggcagcagaucgaggagaaauaguaagaguugacguauuuaccaaaccaaacaagaaagggaaaaaugaauuuuaccugguaccaauauacccacaucaagucaugaauaaagcagaguggccaacgcccccuaugagggcagucgucgcguauaaagaugaaucugaauggacccuacuagaugaaaacuucggauuucuauucucauuauuuccaagaucauaugucgaagugacuaaaccgggaggagaaguauugagcggguacuuucaagguauggauagaaguacaggagcgauaucacuguucaaucaccgagauucaagaucacuuacggaugauagcggaaauaguacaagaggaauaggugccaaaacucuauuaacaaugaagaaauauagcguggauagauuuggaaaaagagcugaaguuaaaucagaaguccggacauggcacgguguagcguguacauauccuacaccaccaggguga

SEQ ID NO: 4962 - RNA, 3165 nt, Artificial Sequence
  Cas9 variant
augaaacuaacaccacucaauuauauacuaggcuuggaucuaggaauagcaucaguagggugggcggucguagaaauagacgaacaagaaaauccgcuuggacuuauugauguagguguuaggacuuuugauagagcagaagucgcaaaaacaggugaauccuuagcauuagcucgaagguuggcgcgaaguucaagaagacuugugaaaaggagagcugacagaauaaagaaaguaaagagacuauuaaaaucagaaaauauauuauuaagcgcagaugaacaauuaccaaaugauguauggcaauuaaggguaaaagggcuagaucaaaaacuugaaagacaagaaugggcagccguacuacuacauuuacuaaaacaucgaggguauuuaagccaaaggaaaaacgaaaguaaaagugaaaacaaagagcucggcgcacuaagauccggaguggcagcuaaucaccaaauuuugcaaucagccgaauauagaacaccagcagagauagcaguaaagaaauuccacguagaagaaggacauauaagaaaccaaagaggagcauauacucacaccuuuaguaggcucgaucuacuagcagaaauagaauuauuauucacaagacaaacagaacucggcaauccacauacaagcgcgaaauuguuagaaaaccucaccgccuugcuaauguggcagaaaccugcauuagcaggagaggcaaucuuaaaaauguuaggaaaauguacguuugaaccuacggaauacaaagcagcuaaaaacuccuacucagcagagagguucgucugguuaacaaaacuaaauaacuuaagaauacucgaacaaggagcagaaagagcacuaacagauaaugaaagguuugcucuacuagaccaaccauacgaaaaagcaaaauucacauaugcacaagcaagaacuaugcucgcgcuaccagaugaggcaauauuuaaagggguaagguaccaaggagaagauaagaaagcugucgaaacaaaaacaauacuuauggaaaugaaagcauaucaucaaauacgaaaagcacuggagaacgccgaucuaaaagcugaauggaacgaacugaagaauaacucagaacuacuugacgacauaggaacugcauuuaguuuacauaaaacagaugaggacauaugccgauaccuugacgguaaauuaucagaaagcauauugaacgcacuacuagaaaaucuaaauuuugacaaauuuauucaguuaagccucaaggcuuuacaacaaauucuaccccuaaugcuacaaggacaaagauaugaugaagcuguauccgcaaucuauggagaccauuacggaaagaaaagcgcugaaauuaaccgcuuauuaccuacaaucccugcggaugaaauaagaaacccaguaguacucagaacucucacgcaggcaagaaaaguaauaaaugcagugguaagauuauacggauccccugcacgaauacacauugaaaccggaagagaaguaggaaaaucauaucaagauagaaagaaacuggaaaaacaacaagaagauaauagaaaacauagagaaagugcuguacaaaaauuuaaagaauauuuuccaaauuuuguuggugaaccuaaaggcaaagauauucuaaaaaugagauuauacgaauugcaacaagccaaaugucuuuauuccggaaaaucgcuagaauuacaccgcuuauuggaaaaaggauaugucgaggucgaucacgcucuaccguuuucgagaacaugggacgacucauuuaauaauaaaguauuaguccuugcaaaugaaaaccaaaauaaaggaaacuugacaccauaugaauggcuagacgguaaaaauaauucggaaccuuggcaaaauuucgucgcaagagugcaaacaagcggguucucacauacaaagaaacaaagaauauugucacauaaacuagaugagaaagguuuuauugagagaaacuuaaaugacacuagauauguaguaagauucuuaugcaauuuuauagcagauaauaugcuguuaacagguaaaggaaaacgaaaaguauuugcaucuaacggacaaauuacagcuuuauuaagaggucgauggggacuacaaaaaguaagagaugauaacgauagacaucaugcauuggaugcagugguaguagccuguucaaccguagcaaugcaacagaaaauaaccagguuuguuagauacgaagaaggaaacguauucagcggagaacgaauugacagggagacaggggaaauuauaccacuucauuuucccaguccaugggcguucuucagggagaauguagaaauccgaauauuuucagaaaacccaaaauuagaacuagaaaauagauuaccagacuauccacaauauaaccaugaguucguacaaccacuauuuguaagucguaugccaacacgaaaaaugacgggacaaggacauauggaaacuguuaaaucagcaaaaagauuagaugaaggguuauccguauuaaaaguaccauuaacacaauuaaaacuaaaugaccuagaaagaauggucaauagagaacgagaaauggcauuauaugagucauuaaaaguacgucuagaacaauucgauaaugauccagccaaagcauucgcugaacccuuuuauaagaaaggaggagcccuaguaaaagcaguaagagucgaacaaacacagaaaagcgguguacugguuagagacggcaauggaguagcagacaaugcgaguaugguacgugucgacguuuucacaaaagcagguaaauauuuucuugucccuauuuauacauggcaagucgcaaaagguauccuaccuaauaaagcaguaacggcaaacguagaugaaauagauuggcuagagauggacgagagcuaucaauucauauucacuauguauccgaaugaucuggucaaagucaaauuaaagaaagaagaguucuuuggauauuauggaggacuugauagagcaacuggagcuauagugauuaaagaacaugaucuagaaaaaucaaaagguagacaaggaaucuauagaauugguguaaaauuagcacuaaguuucgaaaaauaucaaguagaugaauuaggcaaaaacauaagacccugucguccaacaaaaagacaacacguuagauga

SEQ ID NO: 4963 - RNA, 3165 nt, Artificial Sequence
  Cas9 variant
augcgaauacucggaguagaccuaggaguagccucaguugguugggcuuuagugaacgauaaaaauaauaaaauaauagauucaggaguucgcauauucacacagucaaccaacagagagggaaaaacacuagccgcaguacgacgaucauuuaggggaggaagaagaguccuaaguagaagaaaacaaagauuaaaccaauuaaaaaaacuauuuauugcccacaaauugcuaucaaaaucagaauucaaacaccucuucaacagcaaaaacagacuagacauauggcaacuacgugcaaaaggacuugaacaacaacuaaacaacaaagaaugggcgagaguacuguaucacauugcaaaacgccgagcuuaccaaucaaaucguaaauccgaagaaucuggaaacaccgacaaaaaaaaaguacuaaguggcaucucaaaaaacgagaaaaaaaugaacgaauuagguuacaaaacaauuggcgaaauguuauauacugaaaauagauacccugauaaucggauaagaagaaauaaaaaagaccaguauaaacacucaaucagcagagauuuacuaagaaaagaaauagacguucuauuugaaagucaaagagauuuugguaaucaguuugcuacugauggauuaaaagaacacuacaaagauaucgcauucacacaaagaccaauaaaauucaaagcagauuuagucgguaaauguaccuucgaaacacaagaguaccgaggugcuaaaaacugcuucagugucgaaaaaucaacucuccuaucaaaaaucaauaacacagaccuaauagacaaaucaaccggcgaaauuaaaagauuauuugaaauaagcgaauucgauaaacuauuagauauauuuuauucaaucaaagaaguaaaauacacaacacuccgaaaacaacucaaaauuacggaugccuuuaaauucaagcaauuagacuaccaucaaaacuuugaauacaaaacaaacauaaaagccaaaauagaagacuucuauaaauuagaagauuggcuaacuccagaacaaaaaguguuauuagaaaaacaaguucucgacgacaaaaaagaaaaauuuaaauguuacaaauauagcucuauuagaucaauacucucacuuagugaaucccaaaaauucaauggagugaaauaugauacaaaaguggaaaauacaguauucggaaaacuaaauggauaccauucaauuaaaaaagaacuaaacaaagaaguauucgaccuauuauucaucgauaaagacaaauucaacaaaauugcagaaauacucucguaccagaaagaugacaaaucagcaacccaagaucuaaaaaaacaaguauucaaugauuuuaacauggauaagacaauuguaaacgaagcaaucaauucauuacuaaauauaucuuucucaggauucaacucauuaucauuaaaagcaauaaacaaauuguuaccauauuuaugccaaggacuaaaauaccaugaugcaguagcacacucggaauauaaacaucauagucaauucaaggcagcaaauccucaacaauaccuacgaccucuaaacaaagaagaaaacuaccagauuaccaguccaacuguaaaacgagucuucucucaauuccgaaaaguucuaaaugcaguaauacgcaaacauggcagcuucgaugcaaugcacauugaaauggccagagaacucaaaaauucaaaaaagauaaaauucgaaauacaaacaggacaaaaggaauacgcacaagaaaaagaagcaauaagggucaaauuccuagaaauauucaaauacgaagguuccggacgagaucuccuaaaacuuagauuauacgaacaacagcauggcaaauguaucuacaguaaaaaagaaauagaaauaaauaaauuauuagaagacggauauguagaaauugaccacauccuaccuuggucaagaacauucgacaauucacuaaacaacaaagcgcugugcuuaagcgcugaaaaccaaaacaaagccaaucaaacaccauucgaauauuuaacgaacuccgauaaaaauagcaaagauaguaaagaauggcaggaguacaagaacuauguaagcucauucgcaggaauuaaacaggcaaaaaaacauaaacuacuaaauacaacgcuaccaccccgaagggguaaugacuuuagcgaugauauaaaaaauccagaaucaggauucuuagcaagaaaucucaacgacacagcauaugcuucacgauuuauaaaaaacuucguacaaaaccaucuacaguucucccaaaaugacacaauaaaacaaaaagucaaaguacguagcggugcacuaacaaaccagcugagauacaauuggggaauagaagaaaaaaaccgcgauaacaaccuacaucacgcggaagacgcaauuauauuagcauucgcaacucaaggagaagugcaaaggaugucaacaauaagcgcaaaacgagaagacuucaaguaucaaacggccaaggaacgaaaaauaaaauucacaccaccauuuuccgauuucaaauccguauuagacgaaucaguaggcgacauuuucguuaguuuugcacccagacgaaaaauaucaggagcagcacacaaagcgacaauaaaaccuaaagauacaggagguaaauacaaauucccgguaaauaacggcauggcagaaaauggaguaauacagagagucgauguauuuaaaaaugcaaaaaauaaauaucaauucauaguuuucuacccugcagauuuuuacaaagacgacuucccagaauuagaccucaagggcaacgaaauagauaagaacguccaauuuuuauuuucacuauucaaagacgaccucauagaauuuaagaccaaaaaaacaaaaacaaaagacaguaaacaucuuuuagcauacuucaaauacaucagaucagauggaaaaauagccuuccaacagaauuacaaagcugaaauagaaagaaaagaaucagacaauaaaaaaggauacaaagacauccuacuagcaacagggaguggacuagccucauuaaaaaaauaucaaguaaguguacuaggcgacauagcagaaguaaagaacgaaaaaagauuaccacuaauaaaacaaauguauaaaagcaaaccgaagaaaaaauga

SEQ ID NO: 4964 - RNA, 3165 nt, Artificial Sequence
  Cas9 variant
augaaccaaaaauuuaucuuaggauuagacauaggcauaacaucaguuggauacggauuaauagacuaugaaaccaaaaacaucauagacgcaggaguaagacuuuucccugaagcaaauguagaaaacaaugaaggacggcgaaguaaaagaggaucaagaagacucaaacgaagaagaauacaucgacuagaacgugucaaaaaacuauuggaagacuauaauuuauuggaucaaucacaaauaccacagaguaccaauccauaugcaauacgagucaagggccucucagaagcauuaucaaaagacgaacucguaauagccuuacuucacauagcaaaacguagaggaauccauaagauagacguaauugacucaaacgacgacguaggcaacgagcuaucuacaaaagaacaacuaaauaaaaacucuaaacuacucaaagacaaguucgucugccaaauccaacuagaacgaaugaacgaagggcaaguacgcggcgaaaagaacagauucaaaaccgcagauauaauaaaagagauaauacaacuauuaaacguacaaaaaaacuuccaccagcuagacgaaaauuucauuaauaaauauauugaacuaguagaaaugcgcagagaauauuuugaggguccagggaaagguagcccauacggaugggaaggggaucccaaagccugguacgagaccuugaugggacauugcacuuacuuccccgaugaacuucgaagugucaaauacgccuauucugccgaucucuucaacgcauuaaacgaccuuaauaacuuaguuauucaaagagacggacuaucaaaacuagaauaucaugaaaaauaucauaucauagaaaaugucuuuaaacaaaaaaaaaaacccacacuaaaacaaauagcaaacgaaauaaacguaaauccagaagacaucaaaggauacagaauaacuaaaucaggaaaaccccaauucacagaauuuaaauuauaccacgaucucaaaucuguacuauucgaccaaucaauccuagaaaacgaagacguacucgaucaaauagcagaaauacugacaauauaccaagacaaagacucaauuaaauccaaacuaacagaauuagauauacuacucaaugaagaagauaaagaaaacauagcgcaacuaacuggauauaccggcacucacagacugucacucaaaugcauacgucuuguauuggaagaacaaugguauagcucccgcaaucaaauggaaaucuucacacaucuaaacauaaaaccaaaaaaaauaaaccuaacagcagcgaacaaaaucccaaaggcgaugaucgacgaauuuauauuaaguccaguggucaaacguacauucggucaagcgaucaaccuaauaaacaaaauaaucgaaaaguacggaguuccagaagacauaauaauagaacucgcgagagagaacaacucaaaagauaaacaaaaauuuauaaacgaaaugcaaaagaagaaugaaaacacacggaaaagaauaaacgaaauaauuggcaaguauggaaaccagaacgccaaaagacuaguagaaaaaauaagauuacaugacgaacaagaaggaaaauguuuauauucauuagaaucaaucccccuagaagacuuacucaauaauccaaaucauuaugaaguugaucacaucauaccaagaucaguaucauucgauaacuccuaccauaacaaaguauuaguaaaacaaucagaaaauucgaaaaaaucuaauuuaacaccguaccaauacuucaacucaggcaaaucaaaguuaucauacaaccaauucaaacaacacauauuaaaccuaagcaaaagucaggacagaauaucaaaaaagaaaaaagaauaucuauuggaagaaagagauaucaacaaauucgagguacagaaagaauuuauaaauagaaaucucguugacaccagauacgcaacacgggaacuaacaaauuaucuuaaagccuacuucagcgcaaacaauaugaauguaaaaguaaaaacuauaaauggaucauucacagacuaucuaagaaaaguauggaaauuuaaaaaagaaagaaaccauggauacaagcaccaugcugaagaugcccuaaucauagcuaacgccgacuuuuuauuuaaagaaaacaaaaaacuuaaagccgucaauuccguauuagaaaaaccugaaauagaaucuaaacaacuggauauccaagucgacucagaagacaacuacucagaaauguucauuaucccuaaacaaguacaagacauaaaagacuuccguaauuuuaaauacucacaccgagucgacaaaaaacccaaucgccaacuaauaaaugauacacuguauucaaccagaaaaaaagacaacucaacuuacauaguacaaacaauuaaagacaucuacgcgaaagacaacacaacacuaaaaaaacaauucgauaaaucacccgaaaaauuucuaauguaccagcaugacccccgcacauucgaaaaauuagaagucaucaugaaacaauacgcaaacgaaaaaaacccacuggcuaaauaccacgaagagacaggcgaauaucuaacaaaauauuccaaaaaaaacaaugguccaauagucaagucccuaaaauauauuggaaacaaacuaggaucucaucucgacguaacgcaccaguuuaaaucaagcacaaaaaaacuuguaaaacuaagcauaaaaccauacagauuugacguauaucuuacugacaaaggauacaaauuuaucacgauaucauaccuagauguacucaaaaaagacaacuacuacuacauaccagaacaaaaauacgauaaacuaaagcuaggcaaagcaauugacaaaaacgccaaauucauagcaucauuuuauaaaaacgaccuaauaaaacucgacggugaaauuuauaaaauaauuggcgucaauagugacacaagaaacaugauagaacuggaucugccagacauacguuacaaagaauacugcgaauuaaacaacauuaaaggagaaccuagaaucaaaaaaacaauaggcaaaaaagucaacucaauugaaaagcuaacaaccgauguucuaggcaacguauuuacaaauacacaauacacaaaaccgcaacuccuuuuuaaaagagguaacuga

SEQ ID NO: 4965 - RNA, 3165 nt, Artificial Sequence
  Cas9 variant
augaaauugacaccuuugaauuauauacuuggauuagauuuaggaauugcuucaguuggaugggcuguuguagaaauagaugaacaagaaaauccuuuaggccuuaucgauguaggaguacgcacguuugacagggcugaaguuccaaaaacuggagaaucacuagcacuugcucgaagacuagcacggucagcuaggagauuagucaaaaggagagcagacagaauaaagaaagcaaaaagauuacuaaaagcggaaaauauacuacuaagugcugaugaacaccuuccaaaugauguauggcaauuaagaguuaaaggucucgaccaaaaauuggaaagacaagaaugggcggcaguauuacugcauuuacuuaaacaccggggauaccugucacagcguaaaaacgaaagcaaaucggaaaacaaagaacuuggcgcacugcuuaguggcguagaaacuaaucaucagaucuuacaaucagcagaguauagaacaccagcagaaauagcuguaaagaaauuucauguagaggacggacacauuagaaaccagcgaggagcguauacacauacauuuucacgacuugauuuacuugcagaaauggaauuauuauuucaaagacaaacagacuuaggaaauccucauacuucugcaaaauuauuagaaaaccuaacagcuuuauuaauguggcaaaaaccagcauuagcaggcgaagcaauauuaaaaaugcucggaaaauguacauuugaaccaacugaauauaaagcagccaaaaauagcuauucagcagaaagauuuguaugguuaaccaaauuaaacaaucuuaggauacuagaacaaggagcagaaagagcacuuacagauaaugaacgauucgcccuccuggaucaaccauacgaaaaagccaaauuuacauaugcacaagcacggacaauguuagcuuuaccagaugaagccauuuucaaaggaguucguuaucaaggagaggacaagaaagcaguugaaaccaaaacgauacuaauggaaaugaaagccuaucaccaaauccggaaagcauuagaaaaugcugaucuaaaagcagaauggaacgagcucaaaaacaacucagaacucuuagacgacauagguaccgcguucagccuacacaaaacagaugaggacauauguagauacuuagauggaaaauugagugagucaauauugaacgcauuauuagaaaacuuaaauuuugauaaauucauucaacuuucacugaaagcacuacaacaaauacuuccauuaaugcuucaagggcagagauacgaugaagcaguuucagcuaucuauggagaccauuauggcaaaaagagugcagaaauaaaccgauuacuaccgaccauuccagcugacgaaaucagaaaccccguuguccuccgaacauuaacccaagcaagaaagguuauaaacgcuguagucagacuuuauggaagcccggcacgaauccauauagaaacgggcagagaaguaggaaaaaguuaccaagaccgaaagaaauuagaaaaacaacaggaagacaacagaaaacaaagagaaucagcaguaaagaaauuuaaagaauauuucccuaauuuuguuggagaaccaaaaggaaaagauauucuaaaaaugcgcuuauaugaacuacaacaagcaaaauguuuauacagugguaaaucacuagaacuucaucguuuauuagaaaaagguuacguagaaguagaucacgcucucccauucaguagaacuugggaugacaguuucaauaauaaagugcuaguauuagcaaaugaaaaccaaaauaaagguaacuuaacgccauaugaaugguuagacgguaaaaacaauucagaacacuggcaaaauuuuguagcuagaguacaaacaaguggauucucacacacuaagaaacaaagaaucuugucccacaaacucgacgagaaaggauuuaucgaaagaaacuuaaacgauacaagauacgucgcgagauuucuauguaacuucauagcugacaauaugcuauuaacuggaaaagguaaaagaaaaguuuucgcuucaaauggacaaaucacugcuuuacuaagagguagauggggacuacaaaaaguucgggaugacaaugaucgucaucacgccuuagaugcagucgucguugcauguucuacaguagugaugcaacagaaaauuacacgauuuguuagauacgaagaaggcaauguguuuucaggagaaagaauagacagagaaaccggagaaaucaucccauugcacuuuccaagucccugggcauucuuucgcgaaaaugucgaaauaagaauauuuagugaaaauccaaaacuagaguuagaaaaucgcuuaccggacuauccucaguauaaucaugaguuugugcaaccauuauuuguaaguagaaugccaacaaggaagaugacaggacaaggucauauggaaacaguaaagagugcuaagagacuagacgaaggauuaagcguauuaaaagucccauuaacccaguuaaaauuaucagauuuagaacguaugguuaacagagaacgugaaguaacauuauacgaaagccuaaaagcaagauuagaacaauuuggaaaugacccugcaaaagccuuugcagaaccauuucauaagaaaggaggggcagucgucaaagcuguaagaguagaacaaacacagaaaagcggaguucuggucagagauggaaacggugucgccgauaacgcaaguaugguccgagucgauguuuucacaaaaggaggaaaauacuuccuaguaccuauauacacauggcaaguagccaaaggaauauuacccaacaaggcaguaacagccaauguagacgaaauagacugguuagaaauggaugaaucauaccaauuuauauucacaauguauccaaaugaucuaguaaaaguuaaacuaaagaaagaagaauuuuucgguuauuaugguggacuagaccgagcuacaggagcaauugucauaaaagaacacgacuuagagaaaaguaaagggaaacaaggcauauaucgaauaggagugaaauuagcacuaaguuuugaaaaauaccaaguagaugaacuagggaaaaauauaagaccauguagaccaaccaaacgacaacacgucagauga

SEQ ID NO: 4966 - RNA, 3165 nt, Artificial Sequence
  Cas9 variant
augaaagaaaaauauauuuuagggcuagaccuagguaucacuucgguaggauacgggaucauaaacuucgaaacuaaaaaaaucaucgaugcaggaguacgcuuauucccagaagcaaacgucgauaacaacgaaggcagaagauccaaacgaggcaguagaaggcuaaaaaggagacgaauacacagacuugaacguguuaaacuauuauugaccgaguacgaccuaauuaacaaagaacaaauaccaaccucuaauaaccccuaccaaauccgaguaaaaggacuaucagaaauauuaucuaaagaugagcuagccauagcccuacuucauuuagcaaaaagacguggaauacacaauauaaauguaagcuccgaagaugaagacgcuagcaacgaacuaucaacgaaagaacaaauaaauagaaauaauaaauuacuaaaagauaaauauguaugugaaguacaacuacaaagacucaaagaaggccaaauucggggagaaaaaaaccgcuucaaaacaacagauauacuaaaagaaauagaccaacucuuaaaaguccaaaaggauuaccauaauuuggauaucgacuucaucaaucaauacaaagaaaucguggaaacacgcagagaauacuuugagggcccaggacaaggcagcccuuuuggauggaauggugaucucaaaaaaugguacgagaugcugaugggacacugcaccuacuucccacaagaacuaaggagcguuaaauacgccuacuccgcagaccucuucaacgcgcuaaaugacuuaaacaaucucauaauacaaagagauaauucugaaaagcuagaauaucacgaaaaauaucauaucauagaaaacguauucaaacaaaaaaaaaaaccaacauuaaaacaaaucgcaaaagaaauuggaguuaacccagaagauauaaaaggguaccgcauaacuaaaucaggaaccccacaauucacugaguucaaauuauaucaugaucuuaaaaguaucgucuucgacaaaucaauuuuagaaaaugaagccauccucgaccaaauagcugaaaucuuaacaauauaccaagaugagcaaucaauaaaagaggaacuaaacaaacuuccugaaauauuaaaugaacaagauaaagccgaaauugcaaaauuaauuggguacaacgguacacaccgucuaucacuuaaaugcauccaucuaauaaacgaagaauuauggcaaacauccagaaaccaaauggaaaucuucaauuacuugaacauaaaaccaaacaaaguugauuuaucggaacagaacaaaauacccaaagauauggucaaugacuucauccuuucaccaguaguaaaaagaacauucauacaaaguauaaacguaauaaacaaaguaauagaaaaauacggcauaccagaggacauaauaaucgaacucgcgcgagaaaacaacagugacgauagaaaaaaauucauaaauaaucuacaaaaaaaaaacgaagcaacuagaaaaagaauaaacgaaauaauaggacaaacaggcaaucaaaacgcaaagagaauaguggagaaaauaagauuacacgaucaacaagaaggaaaaugccuauacucacuagaaagcauagcacucauggaucuacuaaacaauccacaaaacuacgaagucgaccauauaauuccaagauccgucgcauucgauaauucaauacacaacaaaguacuaguaaagcaaauagaaaauucaaaaaaaggcaacagaacaccauaccaauaccucaauaguucagaugcaaaauuaagcuauaaucaguucaaacaacauauccucaacuuauccaaaucuaaagaucgcauuucaaaaaaaaaaaaagauuacuuacuagaagaaagagacauaaacaaauucgaaguacaaaaggaauucauaaauagaaaucuaguagacacccgauaugcuacgcgagaacuaaccuccuaucucaaagcuuacuucucagccaacaauauggaugugaaaguaaagaccauaaauggcucuuucacgaaccauuuaagaaaaguauggagauucgauaaauaucgaaaccacggauauaaacaucacgccgaagacgcacucaucauagcaaacgccgacuuuuuauuuaaagaaaauaaaaaacuacaaaacacaaacaagauacuggaaaaacccacaauagaaaauaauacaaaaaaaguaacagucgaaaaagaagaagauuacaacaauguguuugagacacccaaacuuguagaagauaucaaacaauacagggacuacaaauucucacaccgcguagauaaaaaaccaaacagacaacucauaaaugacaccuuauauagcacucgaaugaaggacgaacaugacuacauaguacaaacuauaacagacauauacggaaaagauaacacgaaccucaaaaagcaauucaacaaaaacccagaaaaauuccuaauguaucagaaugauccaaaaacuuuugaaaaauugucgauaauaaugaaacaauacucagaugaaaagaacccccuugcaaaauacuaugaagaaacuggagaauauuuaaccaaguacagcaaaaaaaacaacggaccaauagucaaaaaaauuaaacugcuaggcaacaaagucgguaaccaccuagacguaacaaacaaauaugaaaacucaacuaaaaaauuaguaaaacuuuccauaaaaaacuaccgcuucgacguauacuuaacagaaaagggcuacaaauuuguaacaauagccuacuuaaacguauuuaaaaaagacaacuacuacuacauaccaaaggacaaauaccaagaacuaaaagaaaaaaaaaaaaucaaagauacagaccaauuuauagcaucauucuauaaaaacgaucuaauaaaacugaauggugaccuauacaagaucauuggaguaaacucugacgauagaaacauaauagaacuagauuauuacgauauaaaauacaaagauuauugcgaaauaaacaacauaaaaggcgaaccgagaauuaaaaaaaccauaggaaaaaaaacagaauccauagagaaauuuacaaccgacguccuaggaaacuuguaccuccauucaacagaaaaagcaccccaacuaaucuucaaacgaggccucuga

SEQ ID NO: 4967 - RNA, 3165 nt, Artificial Sequence
  Cas9 variant
auggaaaauaaaaauuuaaauuauaucuuaggauuagaccuuggaauugcaaguguuggaugggccguaguagaaaucgaugaaaaagaaaacccauuaagacuaauugauguaggaguuagaacauucgaaagagcagaaguaccaaaaacaggagaaucauuagcauuaucacgaaggcuagcaagaucugcaagaagacuaacccagcgaagaguggcgcgcuugaagaaagcaaaaagacucuuaaaaucagaaaacauacuuuugucgacagacgagagacugccacaucaaguauggcaguuacgaguagaaggguuagaccauaaacucgagcgacaagaaugggccgcagucuuacugcaucuaauaaaacacagaggcuaucuaagccaaagaaagaacgaaucaaaaucagaaaauaaagaauuaggagcauuauuaucaggaguugauaacaaucacaaauuacuacaacaagcuacauacaggucacccgcagaauuagcgguaaagaaauuugaagucgaggaaggacauaucaggaaucagcaaggagccuacacgcauacauucucacgucuagauuuauuagccgaaauggaauuauuauuuagccgucaacaacacuuugguaauccauucgccagugaaaaacucuuagagaacuugaccgccuuacuuauguggcaaaaaccagcacucaguggugaagcuauacuaaaaaugcuaggaaaaugcaccuuugaagacgaauauaaagcagccaaaaacacauauucagcagaaagauucguauggauaacaaaauuaaauaaccugagaauacaagaaaacgggcuagaaagagcacuuaaugacaacgaacgucuggcauuaauggaacaaccuuaugauaaaaauagauuauuuuauucacaaguaagaucaauacucaaauuaagcgacgaagcaauauuuaaaggacuacgauauaguggagaagauaagaaagcaauagaaacaaaagcagucuuaauggaaaugaaggcuuaccaccaaaucagaaaaguacuugaggggaacaaucuaaaagcugaaugggcagagcuaaaagcaaauccaacucuacuagacgagauaggcacagcuuucagccuauauaaaacagacgaagauauaagugccuacuuggcagguaaauuaagucaaccaguacuuaacgcuuuacuggaaaaccuauccuuugacaaauuuauacaauugucacuaaaagcacuauauaaacuccuaccgcuuaugcaacaaggcuuacgguacgaugaggcuugccgugaaauauacggcgaucauuauggaaagaaaacggaagaaaaccaucauuucuuaccacaaauaccagcagaugaaauacgcaauccaguuguucuacguacacuaacacaagcaagaaaaguaauaaacggcguaguaagauuauauggaaguccagcacgaauacauauagaaacaggacgagaaguuggaaaaagcuacaaagauagacgcgaauuagaaaaacgacaggaggaaaacagaaaacaaagggaaaacgcuauaaaagaguucaaagaauauuuuccgcauuucgcaggagaaccaaaagcaaaagacauacucaaaaugagacuauacaaacaacagaacgcaaaaugccuauacuccggaaaacccauagaauuacaucgcuuacuagagaaaggauaugucgagguggaccaugcccuuccauuuaguagaacaugggaugacagcuuuaacaauaaaguucugguauuagcaaaugaaaaccaaaacaaaggaaacuuaacuccauuugaauggcuagacggaaaacacaauagcgaaagauggagagccuucaaggcacucguagaaaccagugcuuucccauaugcaaagaaacaacguauacuaagucaaaaacuagacgaaaaaggauuuauagaaagaaaccuuaacgacacaagauaugucgcacgauuuuuauguaauuuuauagcagauaauaugcacuuaaccggagaagguaaaagaaaaguauucgcuaguaaugggcaaauaacagcacucuuacgaagcagauggggacuagccaaaucaagggaagauaaugaccgacaucaugcucuagacgcaguaguugucgcaugcucaacuguagccaugcaacagaaaaucacaagauuuguuagauuugaagcgggagacguguucacuggagagcgaauugaccgagagacuggagaaauuauaccucugcauuucccaacuccauggcaauucuucaaacaagaaguugagauacgaauauuuucagauaaucccaaauuagaauuagaaaaccgccuaccagaucggccacaagcaaaucacgaguucguacaacccuuauucguaagccgaaugccuacucguaagaugacagggcaaggucacauggaaaccgucaaaucggcaaaaagauuaaaugaagggaucuccguaauuaaaaugccauuaacuaaauuaaaacuaaaagacuuagaauuaauggugaacagagaacgagaaaaagaucuauacgauacucugaaggcuagacuagaagcguuuaaugaugacccugccaaagcauucgcagaaccauuuauaaagaaaggaggagccauaguaaaaucaguuaggguagaacaaauacaaaaauccggaguuuuaguuagagaaggaaauggagucgcggauaaugcgaguaugguaagagucgacguauuuaccaagggagguaaauacuuuuuaguaccaauauauacauggcaaguggcaaaagggauacuuccaaacaaggcggcaacucaauauaaagacgaagaggacugggaaguaauggauaauucugcaacauuuaaauuuagcuuacacccaaacgaucuagucaaauuaguuacaaagaagaaaacaauauuaggcuacuuuaauggccucaacagagcaaccggaaacaucgauauaaaagaacacgaccuagauaaaagcaaaggaaaacaaggaauauucgaaggcguuggaauaaaacucgcauuaucauuugaaaaauaccagguagacgagcuagggaaaaauauucgauuauguaaaccaucgaaacgccaaccuguucgguga

SEQ ID NO: 4968 - RNA, 3168 nt, Artificial Sequence
  Cas9 variant
augaauaauuacaucuuaggauuagauauagggaucacgucaguaggcuauggcauagucgacagcgauacaagggaaauaaaagacgcaggugugcgauuauuucccgaagcaaacgucgauaacaaugaaggacgucguucaaaaagaggagcaaggcgacucaaacgaagaaggauacaccgcuuggauagaguaaagcaucucuuagcagaauauaacuuacuagaucuuaccaacauuccaaaaucuacgaacccauaccagauacgaguuaaaggucuaaacgaaaagcuaucaaaagacgaacuaguuauagcacuccugcacauagcaaagcgaagaggaauccacaauguaaaugucaugauggacgauaacgacucaggcaaugaguuaucaacaaaagaccaacucaaaaaaaacgccaaagcacuuagugacaaauauguuugcgaacuacaauuagaaagauucgaacaagacuauaaaguacguggagaaaaaaaccgauucaaaacagaagacuuuguacgggaagcuagaaaacuucuagaaacacaaucgaaauucuuugaaauagaccaaacuuucauaaugagauacaucgaccuaguagaaacgcgaagagaauauuucgaaggccccggaaaaggcagcccauucggaugggaaggcaacaucaaaaaaugguucgaacaaaugaugggucacugcacauacuucccugaagaacuaagaagcguuaaauacgcauacagcgcagaacucuuuaaugccuuaaaugaccuaaacaaccuaguaaucacucgcgaugaagaagccaaauuaaauuauggugagaaauuccaaauaauagaaaacgucuuuaaacaaaaaaaaacaccaaaccuaaaacaaauagcaaaagaaauuggaguauccgagacagauauaaaaggauacagaguaaauaagucagguaagcccgaauucacucaauucaaauuauaucaugacuuaaaaaauauuuuugaagacucaaaauaccuaaacgacguacagcugauggacaacauagcugagauaauaacaauauaccaagacccagaaaguauuaucaaagaacuaaaucucuuaccagaauuacucagcgaaaaagaaaaagaaaaaauaagcgcauuaucaggauacgcuggaacacacagauuaagccucaaauguaucaauuuacugcuagaugacuuaugggagaguucauugaaccaaauggaauuguuuacaaaauuaaaccuaaaacccaaaaaaauagaccuaucccagcaacauaaaauacccauaaaauuaguugacgauuucaucuuaucuccgguaguaaaacgagcuuucauccaaucaauccaaguaguaaacgcaauaaucgauaaauacggacuuccagaagacaucauaauagaauuagcaagggaaaacaauagcgacgauagacgaaaauuucuaaaccagcuacaaaaacaaaacgcagaaacacgaaaacaaguagaaaagguacuaagagaauauggaaaugacaaugcaaaaaggaucguccaaaaaauaaaacuacacaauaugcaagaaggaaaauguuuauauucccuuaaagacauacccuuagaagaccuauuaaaaaaucccaaucauuaugaaguagaccacauaauaccacgaucagucgccuuugacaacucaaugcacaauaaaguucuaguacgcgcagaggaaaacucgaaaaaaggcaauagaacacccuaccaauacuuaaauagcucugaaaguagccuaucauauaaugaauuuaaacaacauauacucaaucuuagcaaaacaaaagacaggauaacuaaaaagaaaagagaguaccuacucgaagaaagagacauaaacaaauacgacguccaaaaagaauucauuaacagaaaccuaguugauacaagauacgcaacaagagaauuaacuuccuugcuaaaagcauauuucagcgccaacaaccucgacgucaaaguuaaaacaauaaauggaucauucacaaauuaucucagaaaaguauggaaauucgauaaagaccggaacaaaggauacaagcaucacgccgaagaugccuuaauaaucgcaaaugcagacuuuuuauucaaacauaacaaaaaacuuagaaauauaaauaaaguacuagaugcuccaaguaaagagauagauaaaaaacgaguaacgguacaaucugaagacgaauacaaccaaauguucgaagacacucaaaaagcacaagcaaucaaaaaauucgaaauaagaaaauuuucacauagagucgauaaaaaaccaaauagacaauuaauaaaagacacauuauacucaacucgaaacauagacggcaucgaguauguaguagaaagcauuaaagacauauacaguguuaacaacgauaaaguaaaaacaaaguuuaaaaaagauccccauagacuuuugauguacagaaaugacccacaaacauucgaaaaauuugagaaagucuucaaacaauaugaaagcgaaaagaacccauuugcgaaguauuacgaagaaacaggagaaaaaaucagaaaauucaguaaaacaggacaaggacccuauauaaauaaaauuaaauaccuaagggaaagauuaggacgccauugcgauguaacaaauaaauauauaaacuccagaaacaaaauugugcaacuaaaaaucuacuccuacagauucgauauauaccaguacggaaacaacuacaaaaugauaaccauaagcuauauugauuuagaacaaaaaucaaauuacuacuacauaagcagggaaaaauaugaacaaaagaaaaaagacaagcaaauagacgauucauauaaauucauaggaucauucuacaaaaacgacauaauuaacuacaacggugaaauguacagaguaauaggaguaaaugauagcgaaaaaaauaaaauacaacucgauaugauagauauauccauaaaggacuauauggaacuuaauaacauaaagaaaacaggaguuauauacaaaacuauaggaaaaaguaccacccauauagaaaaauacaccacggacauacuaggcaauuuguacaaagcagcaccaccaaaaaaaccccaacuaauauuuaaacgaggcauggaguga

SEQ ID NO: 4969 - RNA, 3168 nt, Artificial Sequence
  Cas9 variant
augacgccaauuucggagucacucuuauucggauuagaugucggaauuaguucauguggaugggcuguuuuaaaacacucugacacaacagggcauauagaagcucuuggaucuugguguuucaaugcaccagaaacaaaaacugaacgaacaccaacuaaccaaauaaggagaucauccagauuacuuagacgaguaguuagaagaaggcgaaauagaaugaccgaaauacgaagacuauuugcuagacaugguuuaauagauaaugauagaccagaugcacuaagacaaccggcuauagauccaugggagaugcguggccaaggauuggauagacaacuaacaccagaagaauucgcaguggcacuagcacacauagcuaaacaccgaggauuuaaaucaagugccaaaagaguaaaaagcaaugcaucaccagaugauaguaaaauguuggcugcacuugaaaaaacaaaagaacuuucagcacaauacagaacaauaggagaaauguuugccagagauuccgccuauguccaaaggcgcaggaacagagauggacuauucgaccgaaccauuaguagagaugacuuaaucgaugaggcuaaaaucuuauuugaucgacaaagaaaauuaggaaauccugucgcaagcacugaaauagaagaggcuuuuacuaggauagcauucuggcaaaacccaaugcaagauaguggcguacuggucgcauccugucccuuugaacccaaggaaaaaagauccucacgauuuagcccaucauuugaacgguuuagacuauugugucgacuuauaaauuugcgaguaacagaugguccugaagaaaggccauuaacggaagaagaauuacguuuagcauaugagcacgcaggaaaaacaagaaaauuaacagcugcugcaauacgaaagcuuauaggauuaagagaugaccaacacuuuaccacaauaccaccagaacaggaaaaacaagacaucacauccagaaccggcgagacuuuugcuggaacagcaaccuuuaggaguguauugggagaaagcuuauggcgacaauuacugccacauccagaaugguuagauaaugcagccuggauuauaaguuuucacgaacuaacagaaacaauaauaaaaaaacuuggcgaaauaggcuugcccguagaagcauaugaauuaauaugcgaugcacuaaaaagcgacaaaagcccuuuugcaaaauuuaaaggcgcaucuuccuuaucugauaaagccgugcgugcuuuaaucccauaccuacagcagggacuuacauacgauaaggcuugccaaaaggcaggauaugaucacgcggcgaguagguuuagugggcgagcuacgauagauacaaaagcuaaauuuaacgcucuuauggcagaaguacgugauucaaucgcaaacccaauugcucgaaaagcgcuaucggaaggaaugaaacaacuaugggcaaugagaaaccgguggggauuaccaggugccauuuguauagaauuagcucgcgacgucggaaacagccuagaaaagcgaaaagaaauugaacggaauuuaaaaacaaccgcuaaacaaagagcgagagaaagagaggaagcaugugaguuacuaaauuuaaaagaaguaaguagugauauauuauuacgauauagacucuggaaggagcaaggaggaagaugcuguuacagugguaaaucaauaacaccagacaugcugauggcacaagauaaucgaauacaaauagaucauauuuuaccauggucaagauuuggggacgacagcuauucaaacaaaggacucugucuggcgaaagaaaaccaagcgaaaaaaaaucaaacaccauacgaauggauucauggucaaggaacgacagcacaaaaagaacaaugggauaaauuuguugcugauguagaaaguagaaaaaacacaaagggccuaaaaaaacgaaauuucuuacuaaaagguucuaaagaaauugaggaacgauuccgaucaaggaaucuuaacgauacgagauaugcugccagacuuaugguagaagcagcuaggcuauuauauccggcaggacaaagaggagagaagggaggaacaagaaggguauucacacgaccuggggcuuuaacugcagcucuacgacaugcaugggggguagaaucacuaaagaaaauagacggugaacgauuacaugauaacagacaccaugcuuuagaugcagcaauugucgccgcgguaucagaagcugaaauacaaaagcugacuaaauccuuccaagaaugugaacaaaaaggacuaagcagacccaugagagacguggcaccaccaugggauggauuucgagaccaauuaaaagagaaauaugaaacaauuuuuguagcacguccagaaaggcagagagcaagaggccaaggacaugaagcaacaauacgacaaguaagggaagaagaaacaggaccagugauauacgagagaaaagcaguaagugcacuaacauuagcagaucucgccaaaauuaaagauccagaucgaaaugcuggcuuaauugcgagccuaagacaguggauagaagcaggcaaaccggcagauaaaccaccacgaacacccugccaccaauccgcagcugggcacgaaauaagaaaagucagauuagcaacaauaaucacaccagcggugccuguacggggagguauggcaaaaagaggagaaaugacucggguugacauauucaaaguaauaggaaagaaaggaaaaccagaaugguacaugauaccaauauacccacaccaaauaaugaaucgcagucaauggccugcaccucccaacaaagcgguaguagcaggcaaauccgaagcugacuggccuauaaugggugcagaagcucaauuucaauuuucauuauauccauguucguauguaagacucuuuaaagaagguacaguaauagaaggguauuucuguggaugucacagaucuagagcguauauaacacuugcauuaaguacaggagcugcuccacuacaaaaaggcauagguauaaaaacucaagaacauauacaaaaauuuucaguaaacagauuuggagaacucucaccugucaaacaagagacgagaacauggcacggaguggcguguaccucaccagaucaacacgauuga

SEQ ID NO: 4970 - RNA, 3171 nt, Artificial Sequence
  Cas9 variant
augaaagcacugaauuauauuuuaggauuagaccuaggaauugcuaguguaggaugggcaguaguagaaauagaccagaaugaguuaccuauacgauuaauagaucuaggaguccgaaccuuugaaagagccgaagucccaaaaacaggggacucauuagcacucgcucgaagauuagcucguucuucaagaagauugguaagaagacgagcaguucgacuauuaaaagcaaaaagacuacucaaacaggaaggaauauuacaagcagaugauuuccacaguagucacuuaaaaccauuacccaauaacccaugggaauuaagaguaaaaggacucaaucauuuacucgacaggaaagaaugggcugcuguucuauuacaucuacuaaaacacagaggguauuugucccaaagaaagaaugaaaguaaaacagacaacaaagaguuaggagcacuacugaaagguguaagugaaaacagacaauuacuacaggcacaggcuuucaguacacccgcagaaauagcaaucaagaaauuucaacaagaagaaggacauauaagaaaucaacgcggugcauacucacacacauucgacagaaaugaucuccuggccgaacuuagguuacuuuuucaaaaacaaagagaauuuaauaacccauauacaucucaaucguuagagcaagcgauagcugaacuauuaauguggcaaaaaccagcacuaaguggagaagcuauauuaaaaaugcuuggaaaaugcacuuuugaaccaagcgaauacaaagcgccuaaaaacaguuacucggcugaauacuuugucuggcuaacuaaacuaaacaacuuaagaauacuagagaauggcgcggaucggggacuaacagcugaagaaagacaauuacugauaaaucaaccauucgaaaaagcaaaauuuacguacgcacaagcacgaaaacuucuagaacuuucagaucuagcaauauuuaaagguguaagauacggaaaagauaaugccgagagcgccacauuaauggaaaugaaggcuuggcacgccauaagaaaagcguuggaaucaaauggucuaaaaacagaauggaauggcuuaaaaaccaaaccagaauuacucgauaaaauaggaaccgcuuucuccauuuacaaaacugacgaggauauaucacaauaucuaaauggcgaauuaaguccagccguauugaacgcauuauuagaaaaucucagcuuugauaaauuuauaagacuuagcuuacaaaguuuggccaaaauacucccauuaauggaacaaggauuaagauacgaugaggcuuguaaacaaguauacggggaccacuacggaaagaaagaacaacuugaguuaagguuuuuaccaaaaauaccaguugaagauauuagaaauccaguuguauuacgaacauuaucacaagcuaggaaaguuaucaauggugucguaagauuauacggaagccccgcaaggauucauauugaaacagggagagaagugggaaaaucauuuagcgaacgcagagauauaaguaaaaggcaagaagagaacaggaaugaaagacaacgagccguagaaaaauucaaagaguucuucccacauuucguuggugaacccaaagcaaaagauauauuaaaaaugaggcucuacgaacaacaacauggaaaaugccuauauucagguaaagaauuagacuuaaacagauuacuagaaaaaggauacguagaaauagaucacgcuuugccauuuagccgaaccugggaugauuccuuuaauaauaaaguauuaguccuagcgucagaaaaucaaaacaaaggaaaucaaacucccuacgaauggcucaacggcaaagaaaaugcagaacgauggaaacuauuccaggcuuuaguaaacggaaguagauucccauacagcaaaaagcaaagaauacucacuaaauaucuagacgaagauggauucagagaaaggaauuuaaaugacacuagauacguugcgagguuucuuugcaacuucauugaagauaauaugcaauuaguaggucaagguaagaaacgaguauuugcgucuaacggacaaauaacugcacuauuaagaagaucauggggaauacaaaaaguaagagaggauaaugauagacaucaugcagucgaugcagucguaguagcaugcucaacuagagcucuacaaaagaaaauaacagacuauguuagauacaaagaaaugaauguauucacgggagagaaaauugaucaagaaacaggagaaauaauaaaauuucauuuuccagaaccauggaaauucuuccgacaagaagucgaaauaaggguuuucucagagacaccagcagaagacguaguaauagcacuuccagauagaccacaagcaaaucaugaguucauacaaccuuuauuuguuuccagagcacccacaagaaaaaugacaggccaagggcauauggaaaccauaaaaagugcuaaacgacucgccgaagggcugucaguaaguagaguaccgcuaacccaauuaaaacuaaaagaucuggaaaauaugguuaaccgagaacgcgaaaaagcacucuaugaagcacuaaaaguaagacuugaaaaauuuaacaaugauccagcaaaagccuucgcagacccuuuuuacaagaaaggcggacaacaaguuaaagcuguuagaguagaacaaguccaaaaaucaggggucuuagugagacaagaaaauggcguagcggacaacgcuagcaugguacguguagacgucuucauaaaaggaggaaaauacuucuuaguaccuauauauacauggcaaguagcaaaaggaauauuaccuaaucgcgcagcaacucagggaaaagaagaagaauauugggacaucauggaugaaacagcuauauuccaauuuagucuauaucagaaugauuuaauaaaacucguuaccaaaaagaaaacuauuuucggauacuuuaacggacuaaauagagcaacauccaacauaaauauaaaagaacaugaccuagacaaaaguaaaggaaaagacggaauauaucuagaaguaggaguaaaauuagcacuaucuuuagaaaaauaccaaguagaugaacuggguaaaaauauacaaccaugucgaaguaugaagaaaagaccacccgucagauga

SEQ ID NO: 4971 - RNA, 3171 nt, Artificial Sequence
  Cas9 variant
augcccaaacagaaaaguacaagauauagacuggcacuagauuuaggaaguacaagucugggcugggccguuuuaagacuaaaugaacaacaugaaccaaacgcaaucauaagagccggaguuagaauauuuaguaauggaagaaacccuaaagacgguucaucuuuagcuguaaccaggcgagcggcuagggccaugagaaggaggcgagacagacuucuaaaaagaaaagcgagaaugaugaacaaacuuguggaauacggauucuuuccugccgacguagcagaacgaaagaaacuagaaaggauuaacccauacgaauuacgugcaaaaggacuagaugcuccacuaacaccgggagaguuugcaagagcauuauuucauauaaaccaaagaagaggauucaaaagcaaccguaaaacugauaagaaagaaaaugauucaggagcacucaaagcagcaauuucccaucuaagacaacaauuacaugaaagaaaagcaaggacagugggugaauggcuauggcaacgcuugcaagcgggacuuggcacaagagcaagauacagggaaagcaggguugcacaagcgaauggaaaaacaagaauagagaaaaguuaugaccucuacguagauagacaaaugauugccgaagaguucgacgcacuuugggcagcucaagcugcauuuaauccucagcaauucagcgaacaggcuagaggagaauuacgagauguccuacuguuccaaagagaucugagaccaguaagaccggguagguguacauuguuaccugaugaagaacgagcuccauuagcguuacccucaguacaaagauuccgaauauuacaggaagcaaaucaucuccgauuacuacacccagaucuaagagaagaaccacuuucguuggcacagagagaugcagucguggaugcuuuagaacauaauaguaaacgaacuuuugaacaacuaagaaaauugcuuaaacuuaauggaacagucaaauuuaaccuugaagacgaaaaacguaaagaacucaaaggaaacgccacgagcgcuacacuaucgaaagauggguuguuuggcgaaaauugguggaacuuagaugaagcacuacaagacgcaauaguauggcaauuaguaucagaacaaucagaagaaaaacuacaaaacugguuacaagccaacacagguguaaaugcaacacaagcagagacuauagccaaugcagggcuaccggaaggauauggaucacucucauacaaagcacuugcaaggaucauaccagcuuuacgugguacggaaguagcaaauggaauagauguaccaagaacauacgaccaagcaguacaagcugcaggauucgcccaucauucggacuuagauucuggauucgacuucgaacacucacaugaugaaguugaacgaauuggagaacgaguaauagcaaguacaggagaaguaaaaccaguauuugcauuuaaacaauuaccauauuacgguaaagcauuaagaagacacguugcguuugcaaaagaacauccaagaaacgaagaagaacgauauggaaaaauugcaaauccaacaguucacauaggguuaaaucaauugaggguuguaguaaaugcauugauuaggcguuauggacgcccaacugaagucguuguugaacuagcaagagaccuaaaacaaaguagagaacaaagacaagaagaacagaaaaggcaagcugacuaucagaaaaggaaugaacauaucagacgagaaauagcgagcaugcaugggugcgcugaagaaaggguuagccacgcagauguucaaaaauggauacugugggaagaauuaaguuuugacguagcagacaggaggugcccuuauucagggguucaaauaagugcgcaaauguuauugaguaaucaaguagaaauagaacacauauuacccuuuucucaaacacuagauaauaguuuaaauaaucguacaguagcaaugagacaagcaaauaggauaaagggaaauagaacuccauggcaagcacgagaggauuucgaaagacaaggcuggaguuaugauagcauauuacaacgcgcugaacgaaugccgaaagcuaaacgauacagauuuucaagggauggauaugaacgaugguuaaaagaagauaaagacuuuuuagcaagagcauuaaaugauacaagguauuuaucacgugucgcaaaaacauacauggaauuggucuguccuuuagguacuagagucauaccaggacaaaugacugcccugcuaagggcuaaauuuggauuaaaugauguuuuagguuuaaacggagagaaaaaccgagaugaucacagacaccaugccguagaugcauguguaauuggggugacagaucaaggucuucuacaaagauuugcucaagcaucagcggaugcaagaggaaacggacucgaaaaacugguagaaaacaugccagucccaugggcaaccuaucgagaucauguaaaaagagcuauacaaugcaucuggguuucucauaaaccagaccacgguuacgaaggacccaugauggaagaaacugcauaugguauucgaaaagacggaaguaucagacagaaaaccaaagcagaugguucaacugggcgugaaauuacacauuuaauaaggauaacagaaccuacacaaaauuuaagacacggagucgaugcacaaggacaaccacuugcuuauaaagguuauguagguggaucgaaugauugcauagagauaacacagaaugaacaaggaaaaugggaaggaaauguaauuacaacauuucaagcauaugauaucguucguagauuagggucaaaacaaggcccacgucgacuuagacaucccacauuagcccaaacauuagauguauaugguaaaccaaagaagcuagugaugagacuaaugauugaugauuguguccgccuagaguuagauggaaauaagaaaacuuuaagaguaguuaaaauaacaggaaauggucaaguuuuuauggcaccaguacaugaagcuaauguggauaaaagaaauagugauaaaacagauccauuugcauacguaucuaaauaugccggaucauuucaaaaagcaaaagcuagaaggaucacaauuucuccaauuggggaacuccaugauccaggauucuga

SEQ ID NO: 4972 - RNA, 3174 nt, Artificial Sequence
  Cas9 variant
augucugauaaaaguaaaauacuaggauuugacauaggaauaacaucuauaggcugggcauacguagaaggagaagaacugauagacugcggagugagaauauucacaaaagcggaaaaccccaaaacaaaagaaucguuagcgcuacccagacgugaagcaagaggagugagacgaagacuugcuagaagaaaaggaagacuaaacgcaauaaaacaacucauuugcaaagaguucggauugaacuaucaagacuacauagcacaagauggagaacuaccgaaagcauaugcuggaaaacucauaaaccccuacgaacuaagaagcaaagcccuaagagaaaaacuugaaaaagaagaauuagcaagaguaauucuccacauagccaaacacagaggcuacggaaacaaacaugcaaaagaaacagacgacgccgaaagcggcaaaaucaagaaagcgauuaguaauaacgagaaaauucucaacgaaaaaggauaccaaagugcaggcgaauaucucuaccaagaauuuuuccaaaaagaacgacuacaagaagagaagaaaggcaacaacacaacaaaagaguucaaaaaugugcgaaacaaagccggcgacuacgaacacuguauugcucagacacaaaugcaaaacgaacuaagacuuauauuugaaaaacaaagagaauuuggauuaaacuucagcgaagaauuuaaaaagaaaguauuggaaaccgcauucuuccaaagaccccuaaaagauuucucggauaaaauuggagauugcacauucaucgaaggagcgaaaagagcgccaaaagauagcuuaucugcgauagaauuugucgcauuaggaagaauaaucaauacacuuaaaaaucuacaaaacacaaguggagaaguguauuccagagacaaaauaaacgaaauacuccaaauaguauuagauaaaggagaaauaagcuacaagaaauuaagagaaauacuagauaucgaaaguucaguaagauucaaagacucaaaauuagacuacacaaaagaacuuaaagaagcugagaaaacaaaauuauuugaaagcaaaaacuuacaaaaauuuaagaaagcacuaggaaguuuugaaggaauaagcagggaaauacuagauagcauagcgaaagaaauaaugauaaccaaagauaaagaaaaauuagcaaaagaacucaagaaauuuccauuagaugaaacccaaauacaaaaucugagcaacuuaaguuuuagucaaacaauaaaccuaucauuggaagcgcuaucgcaaauacuuccauucaugagaggcgaaagggaagauaaaugccuaagauaugaugaagccguagaaaaagcaggccuaaaagaaguagccaaaaacaaaaguaaagacgacuuccucccaccauuagaaaauuacgaacccuaccucgcgaauccagucguagcuagagcccuaucagaauauagaaaaguauuaaaugcacuguuaaggaaauauggcaaaaugcauaaaauacacauagaguucacaagggaaguaggaaaaaguaaagaagaacgaaauaaaauagaaaaagaacagaaagaaaacuucgcaaagaaccaagaagcacagaaacagugcgaaauacuuggacugccaauaaacggagcuaacauccucaaaaugaaauuguggcgugaacaacaggaaucaugcguauacucaggaaaggaaauagcuauagacgaucuaaagaacccagcaauauuacaagucgaccacauauauccuuacucaagaucauucgacgacucuuacaauaacaaaguacucguuuucucaaaagaaaaccaaaauaaauugaacaaaacuccguuugaagccuuuggagaaaacaaagauaaaugggagaaaauauuaagccuugcuaguaagcuaccgaaaccaaagcgacaaagaauauacaacaugcaauucaaagauaaagaacaaggcuuuuuaacacgaaauauaaacgauacaggcuauaucgccaggcuaguaucucaauggaccaaaaacugcuuauccuuugaaaaacuaucagaagaugaagucuccauagcaggcgaaaaagguucaaaggugcauguagaaguaauaagcggaucacuaacagcgauguuaagacacuauuggggacuaggagauaaaaacagagacaaccacuuacaucaugcaguagaugcaauaauaauagcguauucaaacgaaaaaguuauuaaagccuucagcgauuauaagaaacauagagaacaaaauaaagcaaaauucuaugcgaaagaaaucgcagaaucagaauacaaaaagcagaaaguauucuucgaacccacaaaccacuucaggcaaaaaguccucgagaaaauagauucaauauucguaagcaaaccacccagaaaaagagcaagaggagcacuccacgaagaaacauuuuauagcuucgaaagauuaugcaaugacaaagaauaugcgaagaaagagaaaauggauuacggaggaaaagcaggaauacaaaaagcaauagcccucggaaaaauaaggcaaguuggaaccaagauaguuucaaauggaacaaugguuagaguagacaucuuucaacacaaaucaaauggaaaauucuauggaguaccaauauacacuauggauuuugcacucgguguacuaccaaacaaagcaguaguaucaggaaaggauaaacagggaguuauaaaagacugguuagaaauggauagcaacuaugaguucugcuuuagccuauuuaaagacgacuuaauccuaguacagaagaaagaaauggagaaagccgaauuaugcuauuacacagacuucaauucuaauacggccggcauaaaauucgaaaaacacaacaacuuauauguaaaucucaaugaaaaugaacgcaagcuauucacaagcaaagaagucguaaaaggaggcaagaaaaacguauggaaagauaaaacuccuaaagaaauagaacaacucgagaaaaacagaaaaaucauuggaggauuuguaaccauagaagaucucaaaacuuuugaaaaauaucaaguuucaccuuuaggagaaguacaaaaagcagauuucgccccaaggcaagccauaacucuaaaaucaaguccaaaacaucgaauaaacaaauga

SEQ ID NO: 4973 - RNA, 3174 nt, Artificial Sequence
  Cas9 variant
augagcaaucggguaccauauagauuggcauuagauuugggaacaaacagcauuggaugguguuuacuagacuuaaacgggaacggugacccaugcgguguaaggcggauggggguacgaauauuucccgauggaagagacccuaagucaaaggaaaguuuagccgcggauaggagauuagcucgaucuaugagaaggaggagagaccgauaucuucgaagaagaagugcauuaaugaaugcccuaguggcggcaggucuaaugccggcagauagagcaacaagaaaagcauuagagucggaagauccaugugaacuacgagcaagggcauuauuugaaccauuaacagcugggcagguugguagagcauuauuucauuuaaaucaaagaaggggauuuaaaucaaaucguaaggcagcuggugaagaaaaugaagcaggaaagauaaaagcuggaauaagugcauuaaaagccgaaauagaagccagcggcgaaacuacuuuaggagcuugguuagcugccagacaucgaaaaagagagaccgugagagcgagacuggacggcgcgggagcaaaagcaagcuacgaauuuuacccugaaaggggauuaguacaugacgaguuccaggcuauuagaacugcacaggcacuucaucacccagcaguuacggcagaacaaugggauagagucgaaagcgugauuuucagacaaagaccuuuacggccgguccgaccagguaaauguacguuauucccagaccaagaacgagcaccaugggcacuaccaguggcucaagaauuucgaauuuugacugaaauagguaauuuaaaacuguauagaccaggcgaagaaccucgugaacuuucggcugaucaacaugcacagcucuuugcgaaauugugcagaucggcggauuugacauuugagaaaauucgaaaagaauuaaaauuggauccaggacuaaaaguuaaucuagaaggagagaaaagagauagacuuaaaggagaugcagucacgagugcucucucagcuaagaaacgguuuggucccaaauggaaugcuuuaacuccggacgacagaagagauauugucggaagacuuauagaagcagaagaugaagcagaauuagcaggauggcuagagaguguucacggacuuccaagcgagaaugcagcacauacugcagcaagcccaggauuaccagacggcuauuguaggcuaucagagaaggcccuaguaaaauuaguaccucuaaugagagaacaaaggcucagguacgaugaagcuguacuggcauuaaacuugcaucacucagauuuccgaccugaagguuuacuugacgaauuaccauauuauggugaaccacuagaacgauuuauagcuuuuggaaguggagaacccucagacccaccagaacaacaucuuggaagauuuccuaaucccacaguacauauuggauuaaaugaacuuagaaaacuuguaaaucgcauaguagaaagaugggguaaaccggcagauauuguuguagaauuagcuagggauuuaaaaagaucuagagaugagagagacaccauccagagagaacaagcacagaaccaacguaaaaacgaagacagauuugcaaaaauaaaggaauugggcauagacccaagaccggauagcaugcuaaggcuacggcuaugggaagaauugccgaaaguaggaguugggcauguauguguauacacaggggaaccaauugguauuagaagacuauuggaaggugacguagauauagaucacauucuaccguuuagccguaccuuaucagacggcgccgauaacaaaauuguauguguacguagagcaaauagauuuaaaagggacagaagcccaugggaggcauuuggaguaacagcuguagauggauaugauugggcugcaauagcacaaagagccgaagaacugccuaaaaauaaacgguggagauuuuuaccagacgcaauggaucgauuugaaggggaacgagguuucuuagauagacagcuaguagaaacaagacauuuaagucgaguggccagacaauauuuagcuuccaucgucgacuuaaacaaaguucgcguugcaccaggaaaacuaacagccaugcuuagagcacgauggggucucaauaaaauucuuucagauggaaauuuaaagaauaggucagaucauagacaccaugcaauagaugcggcuguguuaggaaugauagaucaaaggcuaguacaauuaguagcacaagcugcagcaagagcagaagcgaaugaacuugaaagacuauuugauggacucccagauccauuugacggguuagcagcaacaucauuuggagaucaaguaagggagaaaaucagaggaauaacuguaagucacagggcagaacacgguuggcaagggagaaugcauaacgacaccgcuuaugguccgguggaggcuguuaacggcguccauacgguaguaaccaggaaaccucuaucaggacuaacagcaaaagauuucccaaauaucagagauaggguuuuggcgaaagcacuagaagaucacguagcagcggaagcagccgcugguaggagcuuuggagaugcauuaggaucauuuaaauggggaggacaaccaguacgaagaguaagaauguuagaugugcuaggaaauccuauaccaauacaagauccaucugggaccguuuuuaaaguguauaaaggagauucaaaugccugguaugaaauuuugagggaucccagagggagauggacaggaaaaauaguaaguacuuuugaagcauacagguuacauagagagugguuagcagaaaccggaggagauucuggaagaggcucaggaguauuuuuagacugggccgcaaaaaggguaguaggugaagcaggaacaccuuuguuuagauuguucaaaggagacuuacuagcucuuggagaagcuccagauagaagaauaguaagaguugucaaauucucggaaggacagguugcacucgcacuucauuuagaagcugguaaucuaaaagccagggacgcagauaaaggugauccauuuaaauaucaauauugcagcccagacucauuaagaaaacaggcggcaagaccagcuggaguagauuuacuaggauauguucaugauaaaggaccgcucgaauga

SEQ ID NO: 4974 - RNA, 3174 nt, Artificial Sequence
  Cas9 variant
augcgaagguugggucuugacaucggaacaaauaguauugguugguguuuaauagaagaugacaagaaaauagucgacauaggagugagaaucuuuucggacggacgugacccaaaaaguggagcgucccuagcuguagacagaagagaugcucgugcaaugcgcagaagaagagacagauauuuaggacgaagaagugcauucuuacaagcucuaguaguccauggcuuaaugccugcugacgcagaugaagcuaaauugguugccgauagagacccauaccaauuaagagcaaaagcauuacauguagcucuagagccauuugaaauugguagagcauuauuucauuuaaaccaaagacgaggauucaaaaguaauaggaaagcagauaggaaagcaaacgcaggggaagacgguaaaauagcugaaggagcaaaagcucuagaucaagcaaugucugaagcaggaguggauacuuuaggucaauuuuuagcuuuaaaagaaacuaaaagagugcgcuuaggaagugauggucaagcauaugauuucuauccacaaagaagacacauagaauaugaauuugauaggauauggaaaguacaaucugaauaccacccugccuuacuuacagaagcggccagagcagcacuacacagaauacuauucuuucaaagaccuuuaaaagcacaagaaguaggauuuuguacuuuugccggagucaaugguauagcagcaaaugaacggcgucuaccaaaagcacacccacuguuucagcagagaagauuauacgaagaagucaaucaauuacguauuguaucugcaggagcagcagauagaccauuaacuuuagacgagagagauaggcuaauauuacgacuacaagauagaaagaaaguuagcuuugauacguuagcaaagaaagauuuaagacuugcagauggcgaaagauuuaauaaagaaucagaaaauagaaaagaguuaaucggagacgaaguacgagcagaaaugucagauaagaaaagguuugggacaagauggguacacuuuggacuagaugagcaauuaaggauauuagcaaaauuacaagaugaagaaaacccagaggcacuacuagauuggcugaggagugaauacggucuggaugaagcugcagcagaaucaguugcuaaugccagauuaccagaaggauacggaagauuuggagaaacagcgacacgucuucuauuagaugcccuaaaagccgaagugauaacuuaugacaaagcagcauugagagcuuuugggcaucacagcgauuuccguacgggugagguacuagaucgccuaccauacuauggagaauuacuaaccagagagauagcaccaggaaaaccugaauauggagauccauuagaacgacaauaugguaaaauaacuaauccaacuguacacaucggguugagacagcuagaaaaauuaguuaacgcagucauagcugugcacggaagaccugaucaaauaguaguagaauuagcgcgagagcucaaacuuaaugaaaaagaaaaagaugagcauaaacggagaauaaaaagagauacugaugcagcaauagcuagagggagaaaacuagcaucagaaggguuuaucgauaacggagcaaaucgaauguuaaugagaauaugggaagaguugaauccagcuaauccauuagacagaagauguccauauugcgcagaacccauaggaauaagagcacuuuucucgggagaagcagauauagaucauauaauaccauauagcagaaguuuggaugauaacguagguaauaaagucguagcacauagaaguuguaaccgagcaaaagggaauaaaacaccauaugaaaaaugggguccacacauagauccagaaagaugggaaagaauuucagaucaaguagcgagguuacauaaaucgaaacaauggcgauuuggaccagacgcgauggaaagaauagaucgagacgguggauuuuuagcaagacaauuaacagauacccaauaucuuucgaggguagccggaaaauaucucagaagucuauaucccacagcacaaaguggaagaguugauguaauaccugguagaaugaccgcuauguuaagaagaaaaugggggcuaaacucauuacuuccagaccauaauuacguggaaaaugaacacucaaaugcacccaaaaaucgauuagaccaucgucaucacgcgauagaugcugcgguugcagccguuacaacuuugucauuaaugcaacaaauagcagaugcugcaggacgcgcagaagacaaaaauuuagaucgacucuucgaagauauaccccagccuuggccaggauuuagagaagaauuaggcgaggcauuaagaucaacuacgguaagucacaaagcggaccacgggagaaaacgacguccuuccagggauagagaugucacggcugcuagacuacauaaugauacagcauaugguuuaacaggugauguagcagcggacggaaaaacgccaauuguaguucauagagugcccuuagcuagcuuaaaaccugcugauuuaauugacccguugaggauuccugauccaguucucagagacgccuuauaugcagcaacacgugaccgaacaggaaaagaauuugaacaagcccuaacgcaauuugccagacaucacccacuauuuaaagguauaaggagagugagaguaagggaaccccuaaauguaaucccgauacgagacgcggcaggcagggcauauaaagcauauaaaggugacgcuaaugcacgauuugaugucuggagacuaccaaauggaaaauggguuucagauauaguauccauguuugaugcacacugcauggcugacaaauccgauagaaggccacacccggcugcaaagaaaguacuaucacuaagacaaaacgauaugguagcaauugaaagaucggguguaacacaaauagcccgcguuguaaaauuuucaacgaacgguaguauagcacuagcugccgacaacgaagcaggagcacuuaaagcacgugaugcugcuccaaacgacguggauccauuuaaauauauauuuucaucagguggaggacuuaaaaacuuaaaagcuagacagguaagaguugacccauuaggaagaguauuugacccaggaccaagggaauga

SEQ ID NO: 4975 - RNA, 3177 nt, Artificial Sequence
  Cas9 variant
augaaaaauaguuacauacuuggacuagacgucggaaucgcaaguguaggauacggcuuaauacauucagacucaaaauccguaauagacgccggaguacgacuauuuccagaagcaaauguagaaaacaacgaggguagacgagcuaaaagaggcagccgacgacuaaaaagacgcaggauacauaggcuagauagaguuaaauacuuacuugcacaauaccaccugauaauugacgacaaaauaccaaaauccacaaauccuuaugcuauccgaguaaaaggauuaucaucagcacuuuccaaaagcgaguuaguaauagcauuacuacaucucgcaaaacgaagaggcauccauaacguaaacguagucauggacgaaaacgaaucgaccaacgaauuaucaacaaaagaacaauuaaaagaaaacgcuaaacaacuagaaaauagauacguaugcgaacuacaauuagaccgauuaaaugaacaauacaaagucagaggcgaaagaaacagauucaaaacagaagacuuugucagagaagccagacaaauucuaacuacccaacaaaaauaucacgacaucgaugaacacuucauagagcaauauacacacuuacuagaaacuagacgagaauauuaugaaggaccaggaaaaggcucccaauacggaugggaaggagacuugaaacaaugguacgaaauguuaauggguaggugcacauacuuuccagaagaacucagaagcgucaaauaugcuuacaccgccgacuuauuuaacgcucuuaacgaucugaacaaccuaguaaucgcacgcgaugaaaaugaaaaacuagaauacuuugaaaaauaccauauaauagaaaacguuuucaaacaaaagaaaaguccaacacuaaaacaaauagcaaaagaaauagacguuaaagaaucugacaucaaaggcuaucgcauaacuaaaaauggcaaaccccaauucaccagcuucaaacucuaccacgaccuaaauaaaauauuccuagacaagaaaaaucuagaaaauauagaacuacuagacgaaauagcauuuauacuaacacucuaccaagauccccuuagcauuaaagaggcuuuagaccaacuccaagaccuacuaacagaaucagaaaaagaagcaauugcacaucucaacggcuacaccgguacacaccgacucagccucaaaugcuuacauuugcugaucgaugaaauguggcaaaccagccgcaaccaaauggaaguauucacagcauuaaaucuaaaaccucaaaaauaccaacuaucgaaacagaaacaaauccccaagaaaauggucgaagaauuuauacuuaguccugucguaaaacgaucuuuuauacagucaauagaaauaguaaauacaauuauaaagaaauacggauuaccugaagaaauaauaauagaauuagcgagggagaaaaauuccgaagacagaagaaaauuucuuaaccgcauacagaaagaaaaugaaaacacaagaaaacaaguagaagaaguaauucgcgaauauggaaacagaaacgcaaaaggauuagucgagaaaauaaaauugcaucaaaugcaagaaggcaaaugucuauacagccuccaaaacauaccgcuagaugaccuacuaagaaacccaucacacuaugaaauagaccacauaauaccaagaagcguaaguuucgacaauaguuuuaauaauaaaguccuaguaaaacaagaagaaaacagcaagaaaggcaacagaacacccuaucaauaucuaaacucaaaugaaaguguacugucauacguacaauucaaacaacacauucugaaucuuucaaaaagcaaagaaagaaucagcaaaaagaaaagagaauaccuauuagaagaacgugacauaaauaaauuugaaguccaaaaagaauuuauaaaucgaaaccuaguugacacaagauaugcgacaagagaauuaguacaacuacuaaaaucauauuucucagcaaaugaccuagacguuaaagugaaaacaauaaauggcucauucacaaacuaccuacguaaagccuggaaauucgacaaaucucgaaauaaaggauuuaaacaccacgcagaagacgcucuaauaaucgcaaacguuucauacuuauucaaacaauccaaagaacuuaaagaagccaacgcaauacucgaaaacaauaaccucagucuaaauaaaaauaaagauaguaaaaaccuuuuaaccgaacaagacuauagaaaaauguuugaaauuccaaaacaaguucaagauauaaaagauuacaaagacuuuaaauauucacaucgaguugauaagaaaccaaaccgacaacuuauaaaugacuccuuauauagcacaagagaaguaaacgaaaaucacuacaucguacagacaguaaaagauauauaugcaaaagacaacaccaaaauaaaagauuuauucuuaaaaacuccagaaaaacuauuaauguaucaacacgauccucaaacauucgaaaaacucaugcuagucauaaaacaauauggagaagagaaaaacccguuugccaaauacuaugaagaaaauggugaauaucuuacuaaauaugcaaagaaugaaaaagguccaacuauaaaacgcuuaaaauacauagguaagaaaguaggaacacacuuagacauauccacaaauuucucuggggccaaaagaaaagucgugcaacucucaaucaaaccguuucguuucgaugucuuucacuccaaagcaggauaucacaugcucaccuuaacauacauggauaucaaaaagaaagaaaaacauuaccaaauacugaaaaacgaauaccaagcacuaaaagaaagauacaaagugccaucagacgcucaauucauagguucauucuauuacaaugaucuaauaucaauaaaugaugaacuauucagaguaauaggaguuaauaacucaacaagaaacguagucgaguuaaauaugguugauauaaauuacaaggauuauugugaucucaugggaauuaagaaaaccccacgaauauucaaaacuauaacaaagaaaacaggaaaaaucgaaaaauacuccacugauauauuaggaaaccaguucaaaguaaaaccauccaaaucaccccaacucauauucaaaaggggugucuuauga

SEQ ID NO: 4976 - RNA, 3180 nt, Artificial Sequence
  Cas9 variant
augaggcgacucggauuggacauugguacaaauucgauaggaugguguuuaacgcaaggcccgggagaugaagcagacggaauugucgauauaggaguacguauauuuucugacggaagagauccacagaguggaacuucguuagcuguagacagaagagaugcgagagccgcaagaagacgaagagaccgguauauugguagaaggagcgcauuucuggauacguuaguagcacacggauuaaugccagcagaugcugaugaagcuaagcuaguagcagcuuuagauccauauacucuuagggcccgagcauuagaagcaccuuuaacaccucaugagauaggucgagcauuauuucauuugaaucaacguagagguuuuaaaucuaauagaaaagcagaacggaaaacuaacgacgcugacgauggaaaaauagcaacagcagcauaugcguuagacagggcaauguuagauggaggauuugauacucuagggcaauuuuuaaaugcucaagaaacaaaacgaguaagaauggauggagaagcacaggguuacgauuucuauccucaaaggagacaugucgaauaugaguucgauaggaucuggacagaacaagcaaaacaucauccagcauuauuaacagaaacagcgcgguaugcacuacacaggauacuauucuaccaacgaccucuuaaagcgcaaguugucgguaaaugcaccuuuguccauucugaagauagauuagcaaaagcacaucccuuauuucaacaaagacgauuauaugaagaaguaaaccaauuagaaguuacaacaccaggagaagcuaauagaaaauuaacacuagacgaaagagacagauugguaagagaacucagccauaagaaagcgauagcauuuacuucguuagcagcaaaaauaaaauuagaaccgggccaauccuuuaauaaagcgucagaaacucgaacacaauuagcuggagaugagguaagagcaguauuaggggauaagaaaagauucgggccagccugggaacauuuugacagggacaggcaguggacaauuguugaaagauuauuggaagaagaagaucccgacgcacuucacgcauuuuuaacccaagacugugguuuagaugaugaacacgcugccgcuacugccaaaacaaguuuaccugaaggcuacggaagacugggagcuacagcaacagcgagaauuuuagcagaacuucaagcggaagucaucacauaugacgaagcuguacgccgaugcggguggcaucauucagaucauagaaccggggaaauauuaccucaauuaccuuacuacggcgaacuauuaacaagggauaucccuccagguacacaagauccaaacgacccaccugagaaaagaugggggagaauaacaaauccuacaguccauauugguuuaaaccaaguacgacaauuaguuaaugcuauaguugcaguacaugguagaccagaucaaaucguuguagaacuagcaagagaauuaaaauuaaaugaaaaagauaaagaagaacauaaccgaagaaucagacgcgauacagcagcagcaauaaaacggucagaaaaauuaacacaagaagguuuuccagauacaggcgcaaacagaaugcuacuaagauuaugggaagaccuaaauccggcgaacccacuagacagaagaugcccauauuguggagccccaauuggaaugagagcguuauuugcaggagaagcugauguugaucauaucauacccuacagccgaaguuuagacgauucagcugguaauaaaguuguagcacacagaaguuguaauagagcuaaaggcaauagaaccccguacgaaaaguggucagacgauccagauagaugggacgcaaucaccgcacaaguagcucgacuacaccgaaguaaacaauggcguuuuggaccagacgcaauggcacgaguagagaaggauggcggauuuuuaagucgacaauuaacagauacucaauauuuaucacgauuagcagguagguauuuaaguagcuuauacccaacaaaagaggaagguagcguauaugugauaccaggacgcaugaccgcuauguugaggagauuguggggauuaaacgauauauuaucugaccacaauauaguggaaaacaagcacucuaacgcaccuaaaaacagauuggaccacaggcaccaugcuaucgacgcagcaguaguagcuguuucuacaagaucccuuaugcaaagaauagcuagaacugcaggacaggcagaagaucguaaucuagaccgauuguuugaaggccuugauccaccauggcccggcuuuagagaucaauuaagagauagauugcuggcagucacaguaucacauaaagcagaucacggaagaacggggacaccaguacccggaaaagaugcaacugcaggaagacuacauaaugacacagcauacgggcucacaggcgaaaccagugcaaaaggguuaccaauaguaguacaucgcgucccucuaacaagccuuaaaccggcagacaucacggaccccgaucgcauacccgauccaguacucagagacgcaaucgaacgcgcgacagcaggcaaaaugggaaaagacuuuacagacgcucuagcgaaauucggaagaaguggagcgcaagagacagaucgaaaaggagaacgucuauuuagaggaacaagaagaguaagagugagagaaccuuuagggguaauuccgauagcugaugccaguggaagaguauauaaagcauacaaaggagacaguaaugcgcgauuugauguauggcgauuaccagauggaaaaugggucuccgauauaguuucaauguuugacgcucacagacccgaccaaggugauagaagaccccauccagcagcgaagaaaguauuaagucuaagacaaaaugauaugauugcaauagagcgugauggagcacccagagaaauuguacgcguaguaaaauucucaacuauuggaagugugcaacuugcagcaacgacugaagcaggcccccuaaaagccagagaugcuagucccccagacguagauccuuuucgauauauuaauucaagcgcgggagguuuaaagaaaauuaaagcaagacagguccgaauagauccuuuaggccguauauuugauccugguccgagauga

SEQ ID NO: 4977 - RNA, 3180 nt, Artificial Sequence
  Cas9 variant
augauagaaagaauauuaggaguugauuuaggaauaucaagcuuaggaugggcuauaguagaauaugauaaagaugacgaggcagcaaacagaaucauagacuguggaguuagguuauucacagccgcagaaacucccaaaaaaaaggaaucgccgaacaaagccagaagggaagcuaggggcauacgccgaguauuaaauagaagaagaguccgaaugaacaugauaaaaaaauuguuuuuacgagcuggacuuauacaagauguugaccuggauggagaagguggaauguucuacucaaaagcaaacagggcagauguaugggaacuaagacaugauggauuauacagacuucugaaaggagacgaacuggcaagaguacucauacacauagcaaaacauagaggauauaaauucaucggggaugaugaagcagaugaagaauccggaaaagucaaaaaagcaggaguuguacuaaggcaaaacuucgaagcagcagggugcagaacagugggugaauggcuauggagagagagaggagcgaauggaaaaaaaagaaauaaacauggagauuacgaaauaaguauucacagagaccuacuaguggaggaagucgaggcaauuuuuguagcucaacaagaaaugagaucgaccauagcgacagacgcguuaaaggcugcauauagagaaaucgcuuuuuucguaaggcccaugcaaagaauagaaaaaaugguuggucacuguacauacuuccccgaagaaaggcgagcgccuaaaucagcuccaacagcagaaaaauuuaucgcuauuaguaaauucuuuucaacuguaauuauagauaacgaagguugggaacaaaaaauaauagagagaaaaacucuagaggaacuucuagauuuugcaguuucaagagaaaagguugaauuuagacaucuucguaaauuucuagaucuaucagacaacgaaauauuuaaaggcuuacauuauaaaggaaaaccaaaaacggcaaaaaaaagagaagcaacuuuguucgauccaaaugaaccaacagaauuagaauucgacaaaguugaagcagaaaaaaaagcauggauuaguuugcgaggagcagcgaaauuacgagaagcauugggaaacgaauuuuauggucguuucgucgcacuggggaaacacgcugaugaagcaacaaaaauacuaacuuauuauaaagaugaaggacaaaaacgaagagaauuaacgaaauuaccgcuagaggcagaaaugguagaaaggcuagugaaaaucggauuuagugacuuuuuaaaauuaucacuaaaagcaauacgagauauacuacccgcuauggaguccggagcaagauaugacgaagccguauuaauguuaggcguaccacauaaagaaaaaagugcaauauuaccaccacucaacaaaaccgacauagacauauuaaauccaaccguaauaagagcuuucgcacaauuuagaaaaguagcuaacgcucuaguacgaaaauacggagcauuugauaggguacacuucgaacuggcaagggaaaucaauacaaagggugagaucgaagacauaaaagaaagccaaaggaagaacgaaaaagaaagaaaagaagccgcggacuggauagccgaaacuucauuucaaguaccauuaacaagaaaaaauauucuaaaaaaacgauuauauauacaacaagauggaagaugugcauauacuggagacguaauugaacuagaacgucuauuugaugaaggcuauugugaaauagaucacauauuaccaagaagcagaucugcagaugacaguuuugccaacaaagucuuaugucuggcacgcgcaaaccaacaaaaaacagaucgaacaccauaugaaugguuuggacaugacgccgcaagauggaacgcuuucgaaacuagaacaagcgccccaucaaaucggguaagaacagggaaaggaaaaauagacagacuauuaaaaaaaaauuucgaugaaaauagcgagauggcguuuaaagauaggaauuuaaaugacacaagauauauggcuagggcaauaaaaacauacugcgaacaauauuggguuuucaaaaacagccacaccaaagcaccagugcaaguuagaucuggaaaacuaacuagcgugcuacgguaucaauggggucuggaaagcaaagauagagaaucccacacacaucacgcaguagacgcgauaauuauagcuuuuagcacacaaggaaugguacaaaaacucucggaguauuaccgcuuuaaagaaacacacagagaaaaagaacguccaaaauuagccguaccauuggccaauuuucgagacgcaguugaagaggcuacuagaauagaaaacacagaaaccgucaaagaaggugucgaaguuaaaagacuacuaauaagccgaccacccagagccaggguaaccggacaagcacacgagcaaacagcuaaaccauacccgagaauaaaacagguaaaaaauaaaaaaaaauggagacucgcaccaauugacgaggaaaaguucgaguccuuuaaagcagacaggguagcaagugcaaaccaaaagaacuucuaugaaacaucaacuauuccgagaguagaugucuaccacaaaaaagguaaauuucacuuagugccaauauauuuacaugaaaugguacucaaugaauugccaaacuuaucucuaggaacaaaccccgaagcgauggacgagaauuucuuuaaauuuaguauuuuuaaagaugaucuaauaagcauucagacacaagguacuccgaaaaaaccagccaaaauuauaaugggauauuucaagaauaugcacggagcuaacaugguucucucaaguauuaauaacucaccgugugaaggauucacauguacaccuguaucaauggacaaaaaacacaaggauaaauguaaauuauguccggaagagaacagaauagcuggcaggugucuucaagguuuuuuagacuacuggagucaggaaggauuaagaccaccccguaaagaguuugagugcgaucaaggaguaaaauuugcauuggaugucaagaaauaucagauagaucccuuaggguacuauuacgagguaaaacaagagaaacgacucggaacgaucccgcaaaugagaucagcgaaaaaauuagucaaaaaauga

SEQ ID NO: 4978 - RNA, 3180 nt, Artificial Sequence
  Cas9 variant
auguccaaaagacuaagauauagauuggcuuuagauuuagggacuaauucaauaggauucugucuuuuggauuuaaauggugacggaagaccauguggcgucagacgaaugggcgugcgaauuuuuccagauuuuaguaaacuacaacaaucuuuagccgcagauagacgauuagcaagaucgaugagaagaagaagggaucguuauuuaaggagacgcaaagcucuaaugaaugcuuuaguugcggcugcauugaugccagcagauccaaaagcaagaaaagcauuggaagcgcuugauccauaugaacucagagcggcggcgguggcaggaccacuaccugcccaucaguuggguagagcgcuauuucauuugaaccaaagaaggggauuuaaaagcaacagaaaagcagcuggugacgagaaugaggcagguaaagugaaaucaggaauuagugcucuaaaagcagaacuagcugcaagcggggcuggaacacuaggacaguggcuugcagcuagacaugcaaacagacaaccaguacgagcaagauuaacgggaacaggugcaaaagcaacguauaguuucuauccagaacgugcauuagugcaugaagaauuucaagcuauuagagcugcucaagcuccacaccacccggggguaacagcagaacaaugggauagaauagaaucagugauauuccaccagcgaccacucaaaccuguaaaaccaggaaaauguaccuuauauccugaagaagaaagggcgccaugggcucugcccaucgcacaaagauuucguauauuacacgaacuccacaauuuaaggauaguaaggcccggacaaggugaagagggauuaaguccagcagauuuugauagauucuuugauagauuauguagaaagggagaucuaacauucaaaacauuggccaaagaauuaaaauuaccaccagaugcuagaauaaacuuggaagaugauaaacgugacagauugaaaggagaugcuacugcagacgcuuugagugcagaaaaaggcaaaagaagaagaauaggagcagcuuggcauaguuuuccagcggacaggcaaagagaaauuguagguagauuaauagacgcagaagacgaaggcgaauuagcugcuuggcuagucgaggaacugggccuaccaugggaaguagcaauacuaacugcagaacgacccggcuuaccugacgguuauugccgauuaucagaaaaagcauuggaacaggucguaccguuaaugcacgaagaacaccuaccauaugaugaagcaguacgagcacucgguuuacaucauagugaucauagaaccggagaauuucuagaugaacuuccguacuauggccuuccauuagagagauuuauagcguuuggaaccggggaagcugaugauccgccagaauuaagaauaggaagauucccuaacccuaccguacauguagcacuaaacgaacuacguaggguaguaaacagaauaauuagaagaugggggaaaccagaggaaauugugguagaacuugcaagggauuuaaaacaaagucgcgcagacagagauaaaacacaacgagaacaagcggauaaucagaaaaagaauuggacacguacacaacaauuaagggaauuaggaauggaaccgacaggugaagcucuauuaagguuaagacuaugggaagaauuaccacgaauagggucagcucauguuuguguguauacgggacaaccgauaagcaugacgcaacuacugcaaggagauguugacgucgaucauauauuaccauucagcagaacauuagcaaauggggcagauaauaaaauaguaugucaucgacgugcaaacagaauaaaacguaaucgaacacccugggaagcauuugguguaguuucggcugacggauacgauugggcugcuaucgcugaaagagcugaaucauugccgaaaaacaaaagguggcgguuuuugccaaaugcaauggaaagauuugaaacugaacgagguuuuauagaccgccaauuggucgagacaaggcauuuaaguagaguugcaagggaauaucugggguguauaguuccacuagaaaaaguuagagcagcucccggccguuuaacagcaauguuaaggggaagauggggcuuaaauaguauauuaagugaugcaaaucuaaagaauagaucagaccaucgacaccaugcaguagaugcagcaguauuaggugugauagaucaaagauuaguacaaagaguagcggaugccgccaaaagagcugaagagaaagaauuggaaaagcuauuugauggacuaccagauccuuucgaaggacucccagguccuucauuuagagaccaaguucaagaaagggcacaggguauuauuguaagucauaaaccagaacacggguggcagggaagaaugcauaaugauacagcauaugguccaguagagcgauugcccgacggaacacauagaguggugacacgaaagccauuagggucacuggcagagaaagauuuuggaaacauaagggauagagcacuagcagcagcacuugagagacaugucgcagaacaagcggcccaaggaagaucauugggagaggcuuugagcugcuucacuuggacaggaggcgaaguuagacgugucagaaugcuagacaaacuagggucgccuguugcuguacaagaugaugacggucauacauucaaacuauauaaaggagacaguaacgcuugguacgaaauucuaagagauggaagaggaagguggacaggacguauagugucaacauacgaagcauaucgauuacaugcagaauggcucgcagaaagaggagacggggguagaucggaugcagcauucccagauugggccgcgcgacgauuaugugcgggaauaggaaaaccauuauucagacuauuuaagggcgacaugcuugcauucggcacagcaccgaauagagaaaucaugaagguaguuaaauuuagugaaggaagaauaguauucgccggccauagagaagcgggaaacuuaaaagaaagagaugcugauaaagaugauccuuuuaaauauaggacguguucaccugaagcauuacgaaaggcacaagcacgucccguggguguagauccagccggauuuguacaugaccgaggcccuuuagaauga

SEQ ID NO: 4979 - RNA, 3180 nt, Artificial Sequence
  Cas9 variant
auggguauuagauuugcuuuugaccuggguacgaacucuaucggaugggcaguauggcgaacagggccaggcgucuuuggugaagauaccgcugcgagcuuagauggaaguggaguacugauauuuaaagauggaagaaauccuaaagauggacagucucuggcgacaaugagaagaguuccaagacaaagcagaaaacguagagacagauuuguucuuagaagacgggaucuuuuggcagcguuacgaaaagcaggacuauuuccuguagaugucgaagaagguagaagacuagcggcgacugauccauaccacuuaagggcgaaagcauuagaugagagucugacaccacacgaaaugggaagaguaauauuucaucuaaaucaaagaagaggauuucguagcaacagaaaagcagaucggcaagauagggaaaaagguaaaauugccgaagggucuaaacgauuagcagagacacuagcugcaaccaacuguagaacuuuaggggaauuuuuauggucaagacacaggggaacaccuaggacucgaucuccgacuagaauuaggauggaaggagaaggugcaaaagcacuauaugccuuuuacccaacacgagaaaugguaagggcagaguuugaaagacuauggacagcucaaucaagauuugcgccugaucuacuaacaccggaacgacaugaggaaauagcggguauuuuguuuagacaaagagaucuagcuccuccuaaaauuggauguuguacauucgaaccuucugaaaggagauuaccucgcgcacugccuaguguugaggcaagaggaauuuaugaaagauuagcacauuuacgaauuacaacugggccagucucggaccguggauuaacaagaccugaaagagauguucuugcaucugcucuauuagcuggcaaaagucuuacuuucaaagcagugagaaaaacuuugaaaaucuuaccacaugcucuagugaauuuugaggaggcgggagaaaaaggccuagacggugcauuaacagcaaaguuguuaaguaaaccugaucauuacggagcagccuggcaugguuuaucuuuugcugaaaaggauacauucguuggaaaacuccuggaugaagcugaugaagaaagacuaauuagaagauuaguaacagagaauaggcuaagcgaagaugcagccagaagaugcgcuucuaucccucuagcggaugguuauggacguuuagguaggacagcaaauacugaaauauuagccgcauugguagaagaaacggaugagacaggcacgguaguaacauaugcagaagcaguacggagagcuggagaaagaacaggacgaaacuggcaucauagugaugaaagggacgguguuauuuuagaucgacuuccauauuauggggaaauccuacaaagacauguuguuccaggcagcggagaaccagaagagaaaaacgaagcagcacggugggguagacuugcaaaucccacaguucacauuggauugaaucaacuuagaaaaguuguaaaccgacuaauagcagcgcacggaagaccagaccaaauagucguagaacuagcucgugaacuaaaauuaaauagagaacaaaaggaaaggcuagauagggaaaauagaaagaauagggaagaaaaugaaaggagaacagcaauacuggcagaacauggacaaagggauacagcugaaaacaaaauaagacuaagguuauuugaggaacaagcaagagcgaaugcuggaauugcauuauguccauauaccggcagagcuauagguauagcugaacuauuuacaucagaaguugaaauagaccauauccuaccgguaagucuaacguuagacgacagccuggcgaacagaguauuaugcaggagagaagcgaaucgagagaaaagacggcaaacaccauuucaggccuuuggugcaaccccagcguggaaugauauaguugcuagagcagcuaaacucccaccuaauaaaagauggcgauuugauccagcagcauuagaaagauuugaaagagaagguggguuuuuaggaagacaacuaaaugaaacaaaauaucuuucacgccuggcuaaaauauaccugggaaaaauaugugauccagaccguguauacguaacaccuggcacauuaacuggauuguugagagcaagguggggauuaaauagcauauuauccgauucuaauuucaaaaaucgaagcgaucaccgucaccaugcaguugaugcaguaguuauugggguacuaacaagagggaugauacaaagaauagcacaugacgcagcaagagcagaagaucaggauuuagauagaguauucagagaugucccagugccauucgaagacuuuagagaccauguaagggaacgaguaagcacaauaacgguagcaguuaaacccgagcacgguaaaggaggggcacuacaugaagauacgucauauggacugguaccagacacagacccgaacgcugcguugggaaauuuaguuguuagaaaaccaauucguaguuuaacagcuggugaaguagaucgaguuagagauagagcacuaagagcaagacuaggagcuuuagccgcaccauuuagagaugagagcggaagaguaagagacgcaaagggacucgcacaggcauuagaggcuuucggagcggaaaaugguauacgaaggguuagaauccugaaaccagaugcgucaguaguaacaauagcagauagaaggacggggguaccauaccgagcuguagcacccggcgaaaaucaucacguagauaucguacaaaugcgggauggaaguuggaggggcuuugcagcauccguuuuugaaguuaaucgaccaggauggagaccagaaugggaaguaaagaaauuggguggaaaacuuguuaugagacuacauaaaggagacaugguagaacuaucagauaaagauggucaaagaagagugaaaguaguacaacagauagagauuucagccaauaggguaaggcuuucaccgcauaacgaugguggaaaacuucaagacaggcaugcagaugcagaugacccauuuagaugggauuuggcgacuauaccauuauuaaaagaccguggguguguagcgguaagaguagaucccauaggagucguuacacugagaaggaguaauguuuga

SEQ ID NO: 4980 - RNA, 3183 nt, Artificial Sequence
  Cas9 variant
auggcaguaaaaucccuaaauuauauacuaggucucgauuuaggaauagcaagcuguggaugggcagucguagaaauggaugaacaagagaauccuuuaagauuaauagacguaggcguacguacuuuugaagaagcagagaauccaaaagacggaucuagccuugcugaaacacgacgacucgcacgagcccaacggcgauugaucucacgaagagcaaaucgcaugaacaaacuuagaagacuauuaaagcaagaaaacgugcuccaggcaaaugacuacgacgagaaaggauuaauaauaggauuaccgaaucaagcaugggaauuacgagcacaaggauuagauaggaaacuugagccaaaagagugggccgcuguauuaauacauuugguaaaacacagaggcuaccuaagccaaagaaaaaacgaaucucaaacagcagauaaagaacuuggagcacuacuaucugggaugaaucauaaucaucaacuauuacaaagucaaucaaaucaauauagaacaccugcagaauuagcaauaaaacaauuugcaacacaagacggucauauaagaaaucaacgcggagcuuauacccacacuuuuaacaggcucgaucuccaaaaugaacucaaccaauuauucgaugcccaaacuagacuugggaacccacaugucagcggaucauuaaaaacagcaaucaacgauuuauuaaugaaucagaaagcagcacuaucuggcgaugcgauucuagaaauguuaggaagauguacauucgagccaagugaauauaaagcagccaaaaacacuuacagugccgaacgauuugucuggcuaggaaaauuaacaaacuuaagaauccaagacaacggccuggagucagcucuaaguagagaacaacgagaauuauugcuaaaugaaccuuacaacaaaacaaaacugacuuaucaacaaguacgaaaacuacuacgacuaccagaaacugcauuuuucaaaggacuuagauacgguaaagacaaugcagaaagugcaacacuaauggaaaugaaaucauaucacgcaauacguaaaucacucgaaaauaagaguuuaaaaucugaaugggagaaauugaaaacucaaccaaaauuguuggaccuaauaggaacggcuuuuaguaucuacaaaacagacgacgagauugcaggcugcuuaaaaaaccaauuaccagaaaacguaaucauagccuuacaagaacaacuaaauuuuucgaauuucauggaauugucacucaaagcacuugagaaacuacuaccucuuauggaacaaggauuaagauacgaugaagccugcacacaaauauauggaaauagacaugaaaaaauagcggacaaaacagaaaaauuccuaccaaacauacccgcagacaaacucagaaacccuguuguacuacgaacacuaacgcaagcccgaaaaguaauaaaugcuauaauuagaagguacggaucuccagcucgaguacacauagaaacaggaagagaaguaggaaaaucauuuagcgaccgugauaaauuaaaaaaacaacaggaagaaaaucaagaacaacgacgaagagcaaucgacgaauggaaacaauuuuucccgaacgcugcgcacgagccaaaggcaguugauauuuuaaaacuacgccucuaucaacuacaacaaggcaaaugucuauacaguggcuuaccaaucgauguuagacgauuaccagaaaaagguuaugucgaaaucgaccaugcccuaccauucagcagaacaugggacgacucauuuaauaacaaaauucuuguacuagcuuccgagaaccagaauaaaggaaaccaaacaccguacgaauacuuacgcggugccgauaauucagaaucuuggagacuauucguagaaaauguacaaaacugucaguuuucacccaauaaaaagcaaaaaauuauggcaaaacaauuagaugaaaaaggauuucuugaaagaaaccuaaacgacacacgauaugucucaagauuuuuaugccaguuuaucagugaauaucuacaccugaccggaaaaggaaaaaaaagaguguuugcaagcaauggacaaaucacagcauuacuucguggacgauggggacuuaguaaaaacagagaagaaaaugauagacaccacgcaguugacgccguaguaguagcaugcucaacuguagcaaugcaacaaaaaauaacucaauucgucagauaucaaaaaggaaacgucuuuacgggcgaaagaauagauaaagaaacuggcgaaguuauaucaauucauuucccuacgccuugggagcacuuuagagaagaaguuaugauacgaguauucgaugauaacccuuuaagaacacuaccagaaaaacucccaaauaggccugaagcccuacacgaauauguaaugccacuauucguaagccgaaugcccacaaggaagaugacaggacaagggcauaaagaaaccauaaaaagcgcaaaaagacuagacgaaaaaauaagcguacuacgcguuccauugacacaauugaaauugaacgauuuagaaaacaugguaaaccgcgagcgcgaaccagccuuguaugaagcccuaaaagcaagauuagaacaauuuaaaaaugacccagcaaaagcguucgcagaaccauuuuucaaacaaggcggucaacagguuaaggcaguaagaguugaaauaguucaaaagagcgguauguuacuaagaaaaauaaaugguguagccgauaauggcaguaugguaagaguagacguauuugaaaaaucaggaaaguucuaccucgugccaauuuacgcauggcaaguugcagaaggaauuuuaccaaaccaugcaguaguacacaguaaagaugaauccgacuggauuuuaauggaugaaucauaucauuucaaauucgcauuguacaaaaaugaccuacuggaaguucaaaccaaaaaaggauguaucaugggauauuucgcaagucuagaccgcgcaacaggugcaauaacaaucagagaacacgacagagacaaaaaaaaaugcaaagacggagaacacaggucaauaggagucaaaauggcauccuccuuuaaaaaguuacaaguggaugaauuagguaaaaacauucacgaaacaagaagcagaaaacgaccuaauauuggcuga

SEQ ID NO: 4981 - RNA, 3186 nt, Artificial Sequence
  Cas9 variant
augcauacccuaccauauacucuaggacuagacauaggaauugcgucaguaggugccgcgcuauuaagugaugaauccauacuuggaaugcacguaagaaccuuuuccgcagcagaaacagauaaagaaggagauccauuaaauaaaaucagaagagaagcaaggagugcccguaggagaauacguaggagagcacacagacuacuucgacuuagacgacuucuuaaacguaccggacuaaucagcgauacgaguuuagaaguacuaaaaacaucuaaaacaccauggcaacuaagaagugaaggacuugaucgacuacuaucccccagugaacuagcugcugcacucuaucauauaguaaaacaucgaggauuucaauccaaucgaaaagcagaauuaaaaacggacgcaaaggcgggacagaugcuaaguggcguaucagcaaaccaacaauuaaugagagauaaaucauauagaacaauagccgagaugguauguaaagacgacgcauucaaagaccauaaaagaaacaaaggggguuccuaucgaaacacauuugcuagaucagaccuagccgacgagcuaaaaacacuacuaaagaaacaaagagaauacgacaauccccuugcaaccccugagcuagaagaagcaguucauacacuuuuaauggcaagaagaccagucuuuaaagacgacgauauagaaaaacucguuggauucuguaccuuugaacauggagagaaaagagcgccgaaagcagcauucucuagcgaaagguuuauauggcuuggaaaauuaaauaacuuaagauuaauuuauccaggagaacagaggucauuaacuccagaagaaaggucccaaauaauuaauuuaccauuuacacaggcuucaguuaaauuuagucaaaucagaaagaaauuagaucuaccugaauauguuagauucaacuuagugcguuauaaaccaggugaagaaaccagcaaaagcgaaacggcaaccuuuuucgaagcaaaggcauuccacgagcuaaggaaaacuuaucgggaguccgguauaagugaacuuugggaaagagaucaacaugacccacaacgacuagaucaaauagcaacagcaauagcaguauauagagacgaugaacgaauuagaaacgaauuaucaccucauacuauagaaaacgaagugguagaagccguacuaaauugugauuuuacucaauucauaaauuuaagccuaaaagcguuaaauaaaauacuaccauauauggaacaaggccaaagauaugaugaagcauguacauccgccggauaccagcaucauagcccacaacaaaacgaagagaaaagcggccgaauacccccuccugauaaaaaugucauaagaaacccaguaguauacagaucucuaaaccaagcaaggaaauuaauaaacgcaauaacaaaaagauauggagcaccagcagccauucaucuugaaauggcgagagacuuauccaaaccauucucugaaagaaaaaguauagaacgagaacaagaaaaauacagaaaacaaaaaguacaacuaagaaacgaguacauagaacacuuugguacagaaccaaauggauuaaacuuauugaaauuuagacucuacaaagaacaagacgcacaaugcgcuuacacacaaaaagcauuagaucuaucaagacuaaacgaagcaggauacguagaaguagaccacauccuaccauacagccgaucauacgaugauucccucuuaaacaaaacacuuguuuuaacggaagccaauagagacaaaggaaaccgaacaccauuugaauuuaugggaggagacgaucaaagucaacacuggcaaaaauuuguacgguggguacaaaugaacccaaaaauucgucaagcaaaaagaaauagauauuuaagaaaagauuuuucagaaaaagcagcuagagaauuuagggaucgacacuuaaaugauacacgauacaucggaagagaauuaaaagcuaugaucgaaagccauguacaauggcauccggacucaaaaaguaaagacuguuguguaguauuaucaggacaacuaacagcauuauuacgaggacggugggguuuuaauaaagacagagcagcgggcgaucuacaucaugccguagaugccgcuguuguugcugcagcaacuagggguaugauucaaagaauggcaagacacucaaaauuucacgaacuaaagaauguaaggaccagcuacgcugauccggacacuggagagguaguaaauuuagcugcggcucgagauuuagaaaaacacuuuccauuaccuugggacaauuuuagaaaugauacacuugcuuaucuaaaccccagcgcaauaucagcugaugaauccgcacaagaagggcauagagguguccgaguuucacgggccccaaccagaaggaaguuaggagccgcacaucaagaaacaauuagaucaaaaggcaaagacaacauucuccuagaacagggauuaucagcaguaaaaacaccuuuaucaaaauuaacuuugaaaaacauagaaaacaugguuggauacgaagaucccagaaacgcagcauuagucaaaguucuaagagaaagauuagaagccuucgguggcgauggcgcaaaagccuucgccccuaaucaaccaccaguauauaaaccaagcaaaccagguaaacaagcaccagaaauaagaucgguaaaaauggcaucaaaaucuaaaggggcauuacacguuagggaagguuuagcagacucaggaagaaugauacgaauagacauauaugaaaccaaaaauggcuacguaggcguaccaauauacgucagugauaaagccagaaguaaauuaccaaaagcauaccccaaaaagggggaagauagagcaaauuggccagagguggauacaaacgacaacuucuuauucucauuauauagcacagauuggaucgaagcuaaaacaaagaaagaaacaauagccggauauguuaaaucguaugacauauucgauggaagacuauuaguauaugcucaugauaacaagaaggugguaaggaaacuuacacuuagcgcauuagcagaccuacaaaaauuacauguuucaauauuaggagaccucuauaagggaggaaccccgaaguguucaccacuuagaaaaggucaagaguuguga

SEQ ID NO: 4982 - RNA, 3186 nt, Artificial Sequence
  Cas9 variant
augcuuagauuagguuuagauauaggcaguacuagcauagggugguuuuuauacagaauuacaaacggcaugauagcugaaauuauugauugugguguuagauuauucagugauggaagagacgcaaaaacugggguuaguucagccguagaacgacgaaacgcuagagcgcuaagaagaagaagagacagauacuuacgucguagagcugcauuaaugagaagauuagcugcagcaggccucaugccagaagauccaucacaggcaaaaccgcucgaacuauuagaccccuauagacuaagagccgaugccuuggacagaagauuagaacuuacagaacuaggcagagcacuuuuucaccuaaaucaaaggagaggauuuaaaucaaacaggcaaacagacagagggaauaacgaaggaggcaaaaucauagacggaagugcaagacuagaucaagcuaugauggcugucggagcucgcacuuauggggaauuuuugcaucuacgccguagucaagcagaagauuuacgacgugucccaucaguaagaacacgacugacacuaagaucaguggaugggggaaaagcugaaacaggguacgacuucuauccugauaggagacaccuagaagaagaauuuaauaaaguaugggcagcacaagcugcacaucacccagucuuaacagacucccuaagacaugaaguauuugaaacuauauucuuucaacgaccacugaaagcgccagcagucgguaggugccuauuuuucccagaaccccgacuaccacgugcucaucccuuaacgcagagaagaguacuauaugaaacaguaaacgcauuacggauuagaaccgaaagcggugcugcgguaccacuggguaaagagcaaagagacaaaguaauaaugcuauuagacggaaaagcacccguaaaagccaucgcuucagcuaaauuaucucuaaaagcaauugcuaaacaccugaaauuaagggauggccagacauuuacauuagaaaaaggaagggauuauauagcgugugauccaguaagggcaucuuugagccauccggauagauuuggucccagauggucuguuuuagaagcggaaguacaagcugaaauaguaggaaggauuagagaugacgaugauaccauggcauuaguagaaugguuaaaacaaguucaugguuuagaugaugcacaugcaagagccaccgcggaugcaccacuuccagaaggcuacggaagauuaggagagaccgcgacaagaaaauuauuagacugcuuaaaagcagaaguacuuacuuacucggaggcaguagguaaagcguuagaucaacaucauagugauagaagaacaggggaaauccuagaaucucuaccauauuacggugaaguauugcaagcucacguaaucccaggaacuggagaaccacaccacgaugauaucacaagguucggaaggauaacaaauccuacgguucauauugggcuaaaucaacucagaaggcuugugaauaggauuaucgcacgauacgggaaaccagcagaaauuguaguggaauuagcuagagauuugaaacaaagcacaggucaaaagaaagcggcaauagcauugaauuugaaaaacaggaaagcagcagaggcuagaagugcguuguugacugaauggggaguuccagauacaggggcuaauagaauguacguacgacucuggcaagaauuacaugaagaccccaugaugagacgauguccguauacaggaacaaucauaucacccagccuuuuauuuucuggugcuauagacauugaccauauacuucccuacucaagaacuuuagaugauuccacagcaaaucgaacauuguguaugaaagaagcaaaccgacagaaaagaaacaaaucaccaucagaagcaagaagagacgguaugagaauuugggcacuagaagaugauaauuuaagacauauaccggaauuuaaaagauggagauuugcagaagaugcuauggcacgguucgaaggugaaagggacuuugaagcgagagcucuaguugauacacaauaccuuucaagaauaucuaaagcauaucuagaaacauuauaugauggagcagaugguaaaucucacgugugggugguacccggaagguuaacugagauguugagaagacauuggggucuuaauggaauacuaacagauccucuucgugacgugacaaaagagaaaaaucgaauggaccaucgucaccaugcaauagacgcagccguuguagcugcaacagaccgaggacugauuaaagcaauggcagaacaagcaagaacagauguugaccaaggaagagaagcucuagcuucaaguauaaugccaccuuggccgggguuuagagaagcaguagcggcacaagucgacaggauaauagucagccauaggccagaucauggcagaauagauuuaacuacgagaaugaaagguagagaucagacuacaggaccacuacacagggacacugcauauggacuaacaggacaauccgaaaaaggagucccucuuguuguaacgagagaaccuuuugauaaucuaacuccaacaaugauuggaaaaauacgagacgaaccgcuaaaagcagcacuagcugccguuacagcuggaaagaaagaugacgcauuugcggaagcauuggcccacuuuagagaccgaccaggaccauaccauggcauaagaagaguaagauugauugaaccaauaucagucguagaaauaagagacgcaaguggacgcgcauauaaagguuauaaaggaaacagcaaccauuguuuugaaguauggagacuaccaggcggugcaauuacagaacauauaguuucgacguuugaugcacaccaacccgguccugaaccucgaccucauccagcugcaaaaagauuauuaagguuauucaaaagugauaugguuaaauuagacgacagcaaauucggaccaguaauagcgacuguagucauguucgaucggaacgguaaaauauccuuagugccacauaccgcaaguaaugcuaggaaaagaugugaaaaauauaaagaagauuuauauuuacgauucacagcuagaacuuuaauagaagcuggggcuagaagaauaauagucgaugaaaccggacauuuccgagacccaggaagaaaaggauga

SEQ ID NO: 4983 - RNA, 3189 nt, Artificial Sequence
  Cas9 variant
auggccgaaaaacaacauagauggggauuggauauuggaacaaacagcauagguugggcugucaucgcacucaucgaggggaggccagcgggucucguugcgacaggaucacgaauauucucagacggaagaaaucccaaagauggaucaucacuagcaguagaaagaagaggcccacgacaaaugaggcgcaggcgagauagauaucuuagaagaagagaucgauuuaugcaagcguuaaucaaugucggauuaaugccuggagaugccgcagcaagaaaagcauuaguaacagaaaacccauacguucuaaggcaaagagguuuagaccaagcacuuacuuuaccagaauuuggcagagcauuauuccauuuaaaucaaagaagaggguuucaaaguaauaggaaaacggauagggcuacagcaaaagaaucaggaaaagugaaaaaugccauugcagcauucagagcagguauggguaaugcccguacaguaggagaagcccuagcaagacgauuagaagauggaaggcccguaagagcgcggaugguuggacagggaaaagaugaacacuaugaauuauauauugcacgugaauggauugcucaggaguucgacgcauuaugggcaucacagcagagauuucaugcugaaguccucgcagacgccgcuagagaccguuugagagcaaucuuauuguuucaaaggaaauuguuacccgucccugugggaaaauguuuucuagaaccuaaccagccaagaguagcagcagcauuaccaucagcacaaagguucagacuuaugcaggaacuaaaccaccuacgaguaaugacauuggcagauaaacgagaaagaccauuaucauuccaagaaagaaaugaucuauuggcacaacucguagcaagacccaaauguggauuugacaugcuaagaaaaaucguuuucggugcaaauaaggaagcauauagauuuacgauagaaucagaaagaagaaaagaacuuaaaggaugugauacugcugcaaaauuagccaaagugaaugcacuagggacgagauggcaggcgcuaucauuagaugaacaagacagacuuguaugcuuacuauuggacggggaaaaugaugcaguauuagccgaugcuuuaagggaacauuauggcuuaacagaugcucaaauugacacacuacuaggacuuaguuuugaagauggucauaugaggcuugggagaucagcacuguuaagaguacuagaugcauuagaaucaggccgugaugaacaaggauuaccacugaguuaugauaaagcugucguggcagcaggguauccugcacacacagcagauuuagaaaacggagaaagagacgcauugccguauuauggcgaguuauuauggcgauauacgcaagaugcgccaacugcuaaaaaugaugcagaaagaaaauucggaaagaucgcaaacccuacuguacacauaggauuaaaccagcuaagaaaauuagugaaugccuuaauucaaagauacggaaagcccgcacagauaguaguugaacuugcacgaaauuuaaaagccgguuuagaagaaaaagaacgaauuaaaaagcaacaaacugcaaauuuggaaaggaaugaacgaauacgccagaaauuacaagaugcuggugucccagacaaucgagaaaaucgucuaaggaugcguuuauuugaagaauuaggucaaggaaauggacuaggaacuccauguauauauaguggaagacaaauaaguuuacaaagguuauucucaaaugauguacaaguugaccacauauuaccuuuuagcaaaacauuggacgauucuuucgcaaauaagguauuagcacaacacgaugcaaacagauauaaagguaacaggggucccuuugaagccuuuggugccaaucgcgauggcuaugcuugggaugauauacgcgccagagcagccguucuuccaagaaauaaacggaaucguuuugccgaaacagccaugcaagauugguuacauaaugaaacagauuucuuggcacgucaguugacagacacagcauaucuuagcaggguggcaaggcaauauuuaacggcaauauguagcaaagaugauguauacgugagcccagguagauuaacagcaauguugagagcuaaauggggauuaaauagaguacuagauggaguaauggaagaacagggcagaccugcuguuaaaaaccgggacgaucaucgacaucaugccauagacgcaguaguuauaggagcaacagacagagcaaugcuacaacaagucgccacgcuagcagcacgggcaagagaacaagaugcagaaagacuuauuggagauaugccuacacccuggccgaacuuuuuagaagauguccgagccgcaguagcacgauguguaguaagucauaaaccagaucauggaccagaaggaggauuacauaaugacacagcuuauggaauaguagcaggaccuuuugaggauggaagguauagaguuagacauagaguaucauuguuugaucuuaaaccuggagaucucaguaauguacguugugacgcaccuuuacaagccgaguuggaaccaauauuugaacaagacgacgcaagagcacgugaagucgcguuaacagcacuugcagaacgauauaggcaaagaaaaguauggcuugaagaauuaaugaguguacuucccauuaggccacgaggagaagaugguaagacacuaccagauagcgcaccuuauaaagcguauaaaggagauaguaauuacuguuaugaacuuuucauaaaugaaagaggccgaugggacggcgaauuaauuucaacauuuagggcaaaucaagcugcauacagaagguuuagaaaugauccugcaagguuucgaagauacacugcugguggcagaccguuacuuaugagacuaugcauaaaugacuauauugcaguggggacggccgccgaaaggacaauuuuccgaguaguaaaaaugagcgaaaacaaaaucacauuggcugaacauuuugaaggaggaacguuaaaacaaagagacgcagauaaggacgauccuuuuaaauaucuaacgaaaaguccaggggcguuaagagaccuaggagcgcgaaggauauucguagacuuaauaggucgcguucuagauccagguauaaaaggcgauuga

SEQ ID NO: 4984 - RNA, 3189 nt, Artificial Sequence
  Cas9 variant
augaauuuaaauuauauacuaggucuagaucuuggaauugccucaguuggaugggcaguaguagaaauagaugaacaagaaaacccacaaagacuaauagauguagguguuagaacuuuugacagagccgaaguccuaaaaacaggcgaaucuuuagcucuugcucgaagacuagcaagaagcagcagaagacuuguaaaaagaagggcagaaagaauuaaaaaggcuaagagauuacuaaaagcugaaaaucuucuacuaucggcagaugaaauacuuccuaacgaggcuuggcaauuacgcguaaaaggcuuagaucaaaaauuagaaagacaagaaugggcagcaguguuacuacaucuacuuaaacacagggguuaucuaagucagcguaaaaacgaaucaaaaagcgaaaauaaagaguuaggugcauugcucagcggagucgcgauaaaucaccaaauauuacaaagugcagaauauagaacuccggccgagauagcaguaaacaaauuccaagcagaagagggacauauaagaaaucaaagaggggcguauacacacacauuuucaagacuggaccuuuuggccgaaauggaacuauuauuccaaagacaagcaacccuaggaaauccacauacuucgacuaaauuacuagaaaaccuaaccgcauuacuaauguggcaaaaaccagcauuagccggugaagcaauauuaaaaauguugggaaaaugcacguucgaaccaacugaguacaaagccgcgaagaauaguuauagugcagaaagauucguuuggcugaccaaacuaaacaauuuaagaauauuagaacaaggcgcggaacgcgcacuuacugacaaugaaagauuugcauuacuugaccaaccauaugaaaaagcaaaacuaacauaugcccaaguacgaacucucuuaggauuaagcgaugaagcgaucuucaagggcuuaagauaccaaggagaagacaagaaagcgguagagacaaaaacuacauuaauggagguaaaagcauaccaccagauaagaaaagcacuagaagguuuagauuuaaaagcugaauggaaugaauugaaaaauaauccggcguuacuagaugaaauaggaacagcuuucucauuauauaaaacagacgaugacauccacagauauuuagacggaaaauuaucugaaagcgugcuuaaugcucucuuagaaaauuuaaauuuugacaaauucauacaacuaucccuaaaagcacuacaacaaauuuuaccuuuaauguuacaaggucaacgauacgacgaagcaguaucagcaauauauggagaccacuauggaaagaaaucggacgaaauugacagauuacucccaaauaucccaacugacgaaauacgaaauccaguaguauuacgaacacuaacacaagcaagaaaaguaauaaacgcaguuguaagacuauacgggaguccagcgaggauucauauagaaacaggaagagaaguaggaaaaagcuaucaagauagaaagaaacuugaaaaacagcaagaagaaaaccgaaaacaaagagaaaaugcugugaagaaauucaaagaauacuuuccaaauuuuguaggggagccaaaaggaaaagauauuuuaaaaaugagacuauacgaauuacaacaagccaaauguuuauacucaggaaaaagucuggaacuauaucgcuuacuugaaaaaggauauguugaagucgaucaugcucuaccauuuaguagaacuugggaugauucauuuaauaauaaagugcuaguauuagcuaacgaaaaucaaaauaaaggaaaugcaacacccuaugaauggcucgacgggaaaaauaauucagaaggauggcaacauuucguagcaagaguccaaacuagcgguuucuccuaugcuaagaaacaacgcguacuuauacaagaacuagaugaaaagucauuuauagaaagaaaucucaaugauacgcgauauguagcaagguuucuauguaaucauauagcagacaauaugcuucuaaccgguaaaggaaaacguaaggucuuugcuucaaacggacagauaacugcacuuuuacgaggaugcugggguuuacagaaaguccgagaaaauaacgaccgacaucaugcccuagaugcgguaguaguagcuugcucaacaaaaucgaugcaagacaagauaacgaaguucguaaaauauaaagaagggagacuuuuuaaagauaagaaagacggaguuuauaaaggugaaaggauaaauagagaaacaggugaaauaauaagccuacacuuucccaccccauggaaauuuuucaaagaaaauguagaaauucgcauauucucagaaaacccgaaacuagaacucgaaaauaggcuaccagacuauccacaauauaaccaugaauuuguacaaccacuauuuguaucaaggaugccgacucgaaagaugacaggacaaggacacauggaaacugucaaaucagccaaacgacuugauaaaggucuaagcguacugaagguaccguuaacacaguuaaaacuaucugaccuagaaagaaugguaaacagagaacgugaaauggcacuguaugaagcucuaaaagaauguuuagaacaauuuggaaacgauccagcuaaagcguucgcagaaccguucuauaaaaagggaggagcuuuaguaaaagcuguacgcguagagcaaacucaaaaauccggagugcuaguacgcaacggcaauggcgucgcagacaaugccacaggaaguauaguaagaguugauguuuucacuaaaggagggaaguacuuucuuguaccaauauacacuuggcaaguugcaaaagguauauuaccuaauaaagcaguaauccaagguaaagaugagucagaaugggaagaaauggaugaaaacgcgguuuuccaauucucaaugcacaaaaaugaccuuauuaaaguaaaaacaaagaaaggagaaauauuuggauauuuuaacggacuagauagagcgacaggaaguauugaaauagaagaacacgaucuagagaaaucuaaaggcaaaaauggaagucaucguggacugggaguaaaaacagcauucuucuuggaaaaauaucaaguugacgaacugggcaaaaauauaagaccauguagaccgacaaaaagacaacauguccgauga

SEQ ID NO: 4985 - RNA, 3192 nt, Artificial Sequence
  Cas9 variant
auggaaaaucauauaaauuacagacuaggccuugacauagggauagccucagugggcuggagcguuauaaaucucgauaagaaaagaauagaagacuuaggaguaagaauuuucaaugcugcggaacacccaaaagauggaaguagcuuggcacuuccgagaagaaucgcaagaggaaggcgaagguuguuaaggagaaaggcauacagaguaaaaagaguaaggaaauuaauuguagacuauaauauauuaacaaaagaucagcuaaacgaccuauuuaaacaaaaaugucaaaauuccguaugggaaauaagagucaaagcauuagacaacaaaguaacaaaugaagaaugggcuaggcuacugauaaauuuaugcaaaagacgaggauuuaaaagcaacagaaagaacgaagcagaugacaaagagaccaagaaaguaauaaauagcauaaaaucuaauauuaaaggaaugaaagaaaguggcaguagaacaauaggagaauauaucuauacacaaacccugagcaguggcgauaucucaaaaucauucagaaauaaagauggucaauacaauaauugcguauccagaaaaaugauagaggaggaaauuaaaauacuauuuaagaaacaaagggaacugggaugcgaguucgcuucagaagaaauagaagaaaaauaucucgcaauauucaauucacaaagaccauuuaguaaauucgaagauuuagagaaaaugguaggauucuguacguuugaaaaagcgagcaaagaaaggagagccccaaaauguagcauaagcgcugaagaauuuguauuauacgauaacaugaacaaacuauccauauuaaauaaaggagauacaagaaaacuaacuaacgaagaaagaaaaaucaucguagaaaaugcauucaaaaacaaagaaauaaaauauucaaaacuacgaaagauauuaaaucuguccaacgacgaaagauucagcacucuuucauacagcaauaaaaccgaacuaagcaaaacagaaaacagcaaauuuguagcauuaaaaggauaccaugaaauaaaauccgccauugaaaagagcuuuggaaaagacacauggaacagggucaaaaauaauaggacaaugcucaaugauauagcguauguucuaagcauagcaaaaaccgacgaagacauaaucaaacaacuaaguuuaagaaacauaccuagggaaauaauagaugcuguuuuaggucuaucauuuucaaaauucagcaaucuaucuauuaaggccaucgagaaaauacuaccuuaucucaaagacggacagcaauauaaugaagcaugcaaaucagcaggauacgacuucaaagcaacauacaauggagagaaaagcuauaaacuccccuuaauagauauagacgaaauaguaaauccaguagugaauagagcacuaagucaaacaagaaaaguuauaaacgcaguuauagacagauauggcucaccaauaggaauuaauauagaacuggcaagagauuuagccaagaauuuuaaagaucgaaguaaaaucaaaaaggaacaagaagaaaaucgcgcuaacaaagagaaaaucaaaaaugaauuaaaaauguuaaugaacaaagaaccuaccucaucagaaauacuaaaguacagacucuggaaagaacaacgagaagagugugcauauagucaagaaagaauauauauagaagaccucuucaaaguaggacaguacgagauagaccacaucauaccauuuaguaggagcuuugaugauucuuuaaacaacaaggucuuaguaaaagccgcugaaaaccaacgaaaagcaaaccgaauaccauaugaauacuuuggcagcgaugaagaucgaugguaccgcuucgaaguauggguugaacagucaucacuuagcuucaaaaagaaaaauaaucuacucaagaaaagauuuucccgagaagacagcauagaauuuaaagaucgaaauuuaguagacacacaauacauaagcagauacauuucaaacuucauaaaaagccgauuaauauucaaagaaagcgacucaaaacaaaaaguaauaacgauaaacggacgagcaacuucauaucuaagagcaaaauggggauuauuaaaaguaagagaaaauggcgacaaacaucacgcauuagacgcaacagucauagcgguagcaacgcaaggaaugguucaggagauaucaaaauacucgaaagcccaugagcuaaaauacauuagacaaggagacgaguucauagacauagaaacaggagaaauaguaaaaguuaaagaccacaaacaccuaucaaaagaucguuuaccagaaccauggcuaggcuucagcagcgaacuacgacuccggcuuucugaaaauccaauagaagaauuaaagaaaaguccgauaagcacauacgaugaagaauuuauacgaaaaacaguaagaccaauauuuguaaguagaguccccuacagaaaagucacgggaagacuauucgaggaaaccguauauagcccaaaagccuuuauagacgaagguuucaucgccaaaaagaaacuacaagauuugacauuaaaagauuuugaaaacaucuacaauuacaacagugacaagaaacuauacgaugcauuacgcgaaagacuagaagaauaugguggaaacgcaaagaaagcguucgcagaagaguuuaggaaaccaacgaaaacaggaaaauuaggaccuauaguaaaaucaauaaaaguaaaaacaaaaauuccauucaaagauggaauagacuugaauggagggaaagugaagaaagauggucuaguaagaauagacauauacgaaaaagagggaaaauacuacguagugccaguguauagauuagacauucaacaaggaaauaucccaaagaaagcugcaguagcuaacaaagaagaaaaagacuggauacuuauggaugaaaguuauaacuucaaauuuagccuuuacaaaaaugacuuaauauacauaaaauacgacuccaaaggagaauacuucggauacuaugacggauucgacagacauacaggagccauaacacuagaacgacacgacaacuccgagagauauaggggaauaggaauaaaaacgggcguaaaagagauauuuaaauauaacgucgacguucuaggacgauauuauaaaguugcaaaauga

SEQ ID NO: 4986 - RNA, 3192 nt, Artificial Sequence
  Cas9 variant
auggaaaaguuucauuauguucucggccuagaccugggaauagcuucagugggaugggcagcuauugaaauagauaaagaaacagagacaucaauuggacuccuagacugcggugucagaacauuugaacgcgcggagguuccuaagaccggggauucauuagcgaaagcuagaagagaggcucgaagcacaagaagacugauaagacgacguagccauagauuauuacgacuaaaaagacuacuaaaaagagaaauauucagacaaccagaaacauucaaagauuuaccaauaaaugcguggcaacuuagaguaaaaggguuagauucacgacucaaugaauacgaaugggcagcuguauuacuacaucucgucaaacauagaggcuaccuuucacaaagaaaaagcgaaaugucagagacagacucgaaaucagaaaugggccgacuuuuagcggguguagcagaaaaccaucaacuacuacaacaggaacaauaucgaacuccggcugaauuagcucugaagaaauucguuaaacacuucaggaauaaagguggagauuaugcacauacauucaacagacuagacuuacaagcagaauuacaccuacucuuccaaaaacaaagagaauuaggaaacccauuuacaaguccugagcuagaaagacaaguagaugaucuuuuaaugacucagagaucagcucuacagggagaugcaauuuugaaaaugcuaggucacuguggcuucgaaccagaacaauucaaagcagccaaaaauacauucucugccgaacgauucauauggcuaacaaaauuaaauaaucuacgaauacaagaccaaggaaaagaaagagcauuaacagcagaugaaagaacaaaacuauuagaugaaccauauaagaaaagcaaauuaacauaugcacaaguaagaaaacuucuaucucucccacaaacagcuauuuuuaaaggauuaagauaugauuuagaacacgauaagaaagcugagaacuccacucuaauggaaaugaaauccuaccauaauauaagacaaaccuuagagaaaagcggauugaaaacagaauggcaaucaauagcaacucaacccgaaauccuugacgccauagguacagcuuucucaauauauaaaacugaugaagauauaucccacgagcuuaaaacauguagacuuccagaaaauguguugaacgaacuauuaaagaauauuaauuucgacggauuuauccaacuaucacuaacugccuuaagaaaaauauugccgcuaauggaacaaggguauagguacgaugaagcauguacgcaaauauauggcaaucaucacucuggaucauuacaacaggaaucaaaacaauuuuuaccgcacauaccuauagacgaugucagaaauccagugguauuucggacauuaacacaagcaagaaaagucguuaaugcaaucauuaggagguauggaucgccugcaagaguacacauagaaauggcgcgagaauuaggcaaaucaaaaucggauagggauagaaucgaaaaacaacaacagaaaaauaagaaagaacgagaaaaugcaguagcaaaauucaaagaagacuuuccggacuucguuggcgaaccucgagggaaagacauucuaaaaaugagauuauacgaacaacaacacggaaaaugccucuacucaggacaugacauagacauaaauagacuaaaugaaaaaggcuauguggaaauugaccaugcacuaccuuuuaguagaaccugggacgacucacaaaauaacaaaguuuuaguacucggaucugaaaaucaaaacaaaagaaaucagacacccgaugaauaucuagauggagcuaauaauucucaaaggugguuagaauuucaagcaagaguacaaaccugucacuucucauaugguaagaaacaaagaauacaacuagccaaauuagacgacgaaacggaaaaaggauuccuagaaagaaaucuaaaugacacucgauacauugcacguuuuaugugucaauucgugcaagaaaaucuauaucuaacaggcaaagguaaaagauuaguauuugcaaguaaugggggaaugacagcaacauuaagaaaucuguggggacuaagaaaaguaagagaagauaaugauaggcaucacgcccuugaugcaaucguaguagccugcucuaccgcgucaaugcaacagaaaaucacaaaagcauuccaaagacaugaaaguauagaauauguagacacagaaacaggcgaagucaaauuuagaaucccacagccaugggacuuuuucagacaagaagucaugauccgugucuuuuccgaucaaccaugcgaagaucuuguugaaaaacuaagugcaagaccagaagcauuacaugauaacguuacuccacuauuuguuucuagagcaccaaauagaaaaauguccggacaaggacaccucgaaacaaucaaaagugccaaaagauuaagugaagaaaacaguaugguuaagaaaccuuuaacuacauuaaaacucaaagacaucccagaaaucguugguuaucccaguagagaaccacaacuguacgcagcauugaaaacuagauuggaaacacaugaugacgaucccauuaaagcauuugcaaaaccauucuauaaaccaaacaaaaauggagaacugggagccuuagugagaucaguaagaguaaaaggaguucaaaacacaggaguaaugguacaugauggaaaaggaauugcggacaacgccacaaugguaagaguagaugucuacacuaaagcagggaaaaauuaucuagucccaguauacguauggcaaguugcgcaaggcauacuuccuaacagagcaguuacgagugggaaaagcgaagcugauugggacuuaauagacgagucauuugaguucaaauucaguuugucaagaggagaccuaguagaaaugaucucuaacaaaggucggauauuugguuacuacaauggacuagauagagcaaacgguagcauuggaauaagagaacaugauuuagaaaaaucaaaaggaaaagauggaguacaccgaguaggggucaaaacagcuacagcauucaacaaauaucacguagacccucuaggaaaagagauacauagauguucaagugagccaagaccgacucuaaaaaucaaaucuaaaaaguga

SEQ ID NO: 4987 - RNA, 3192 nt, Artificial Sequence
  Cas9 variant
auggaaaaagacuacauacuuggacuagacauaggcauaggcucaguugguuacggucuaauagauuaugacacaaaaagcauaauagacgcuggcguaagauuauuuccagaagccaacgcugauaacaaucucggaaggagagcaaaaagaggcgccagaaggcuuaaacgacgccguauucacagacuagaacgugucaagucccuacuaucagaauauaaaauuauaagcggacuagccccaacaaacaaccaacccuauaauauaagaguaaaagggcuaaccgagcaauuaacaaaagacgaacuagcagucgcacucuugcacauagccaaacgacgagggauucauaaugucgacgucgccgcagacaaagaagagacagcaagcgauagccucucaaccaaagaccaaauaaacaagaacgcaaaauucuuagaaucuagauacgugugugaacuacaaaaagaacgcuuagaaaacgaaggucacguaagaggaguagaaaacagauucuuaacuaaagacaucguuagagaggcaaaaaaaauuaucgacacucaaaugcaguauuaccccgaaauagaugaaacauuuaaagaaaaauacaucucauuaguggagaccagaagagaauacuacgaaggacccggaaaggguucaccauauggaugggaugcagauguaaagaaaugguaucaacuuaugaugggacacuguacguauuucccugucgaauucagaagugucaaauaugcauacacggcagaucucuauaacgcguuaaaugaucucaacaaucuaacaauagcaagagacgauaaccccaagcucgaauaccacgaaaaauaccauauaauagaaaacgucuucaaacaaaaaagaaacccaaccuuaaaacaaaucgcaaaagagauaggagugaaugacauaaacaucucaggauaccgagucacaaaaagcggaaaaccgcaauucacaagcuuuaaauuauuucaugacuuaaaaaaaguaguaaaagaccacgcaauacucgaugacauagaccuauuaaaccaaauagcugaaauacuuaccaucuaccaagacaaagauucaauaguugcagagcuaggacaacucgaauauuuaaugucagaagcagauaaacaaucuauuucagaauuaacaggauacacagggacacacucacuaucucuaaaauguaugaacaugauaauagacgaacuauggcacucauccaugaaccaaauggaaguauucaccuauuuaaacaugaggccgaaaaaauaugaacuaaaaggauaccaaagaaucccaacggauaugauagaugaugcaauccucaguccaguaguaaaaagaucauucaaacaagccauuggaguaguaaaugcaauaauaaagaaauacggacucccaaaagacauaauaauugaauuagcacgagaaucaaacucagcagaaaaaagccgauacuuaagagcaauacaaaaaaaaaacgagaaaacacgagaaagaaucgaagcaaucauaaaagaauacggaaaugaaaacgcuaaaggauugguccaaaaaauuaaacuacaugacgcucaagaaggaaaaugccuauacucacuaaaagauauaccucuagaagaccuccuccgaaacccaaacaacuacgauauugaccacaucauaccacgaucaguaucauucgacgacagcaugcauaauaaaguacuugugcggcgagaacaaaacgcaaaaaaaaauaaccaaacuccauaucaauauuuaacaucgggauaugcagauauaaaguacucuguuuucaaacaacacguguuaaaccuagcagaaaauaaagaucgaaugacaaaaaaaaagagagaauauuuacuagaagaacgaaauauuaacaaauaugaugugcaaaaagaauucaucaaucgaaaccugguagacacuagauacacaacaagagaacucacuacuuuauuaaagacauauuuuaccauaaauaaucuagacguaaagguaaaaacaauaaauggcagcuuuacugauuuucuacgaaaaagauggggauuuaagaaaaauagagaugaagguuacaaacaucacgcagaagaugcacuaaucauagcuaacgcugauuacuuauuuaaagaacauaaauuauuaaaagaaauaaaagacguaucggaccucgcaggagacgaacgaaauuccaauguaaaggacgaagaccaauacgaagaaguauucggggguuacuuuaaaauugaagacauuaaaaaguacaaaauaaaaaaauuuagucauagaguagauaaaaaaccuaauagacaauuaauaaaugacacaauauacucuaccagagucaaggacgauaaaagauauuuaauaaacacacuaaagaaucuauaugauaaaucuaacggugaccugaaagaaagaaugcaaaaagacccagagagccuacuuauguaccaucaugacccacagaccuucgaaaaguuaaaaauaguaaugagucaguaugaaaaugaaaaaaacccacuagcaaaguauuucgaagagacaggacaauaucuaacuaaauacgcaaaacacgacaauggaccagcaauacauaagauuaaauacuacggaaauaaacuuguagaacaccuagauaucacaaaaaacuaccacaauccucaaaauaaagucguacaacugagucagaaaaguuucagauucgacguguaccaaacagauaaaggauacaaauuuauaaguauagcauaccuaacauuaaaaaacgaaaaaaauuauuaugcgaucucacaagaaaaauaugaucaacuaaaaucagaaaaaaaaauaagcaauaacgccguuuucaucggaucauucuauacaagcgacauaauagaaauaaauaaugaaaaauuuagaguuauaggugucaacuccgacaagaacaaccucauagagguugaccggauagauauacgucaaaaagaauucauagaguuagaggaagaaaagcaggucaauuauaugaacucugauucauaccugaagaacaacagaauaaaaguaacaauaggaagaaaaaccacaaacauagaaaaauuccauacagacauauuaggaaacauguacaaaucaaaaagaccaaaggcuccacaauuaguauucaagaaaggauga

SEQ ID NO: 4988 - RNA, 3195 nt, Artificial Sequence
  Cas9 variant
augucagagugcgucacgaggcgaauauuaggaauugacuuaggaauugcuaguugcggauggggaguaaucgaaguaggagaagcauccggaucaauaauugcuagcggaguacgauguuuugacgcuccuuuaauugacaaaacaggugagccuaaaucagccacgagaagaaccgcuagaggacaacguagaauaauaaggagaaggagacaaagaaugaacgcaguucgaagacuacuagcagaguuuggaguacuuacagggcgaucgccugacgccuuacaccaagcauugcuaagguuaagucaaaguguagcuggaagucagguaacaccuuggacucuaagggcggcagcucaugaaagaaaacucacaaacgacgaauuagcaguaguacuuggacauauagcaagacaccggggauuuagaucaaauagcaaaaaugacggaggugcgaaugcagccgaugaaacaucaaaaaugaagaaagcgauggagacaacgcgagaaggacuagcacgauaucacagcuuuggcgcgaugauagcgagcgacccaaaauucgcugauagaaaaaggaauagagauaaagacuacagucacacggccaaacguucagaucuugaagacgaaguacgcacgauuuuucgaagucaaacacgguucgguagcuuaguagcaucugaaaaauuaagucaggcguuugcagacgcagcguucuuucaacgaccuuuacaagauagcgaagacauggucgguucaugucccuuugaaccagggcaaaaacguaccgcaagacgagcaccgucauuugaacuauuuagauuccuaagcaggcuggcaaaucucaaacugacuguuggacgagcaccagaaagaagauugacaccagaugaaauagcacuagccgcaaaagguuucggagaaaccaagaaaucaauaacauuuaaaucauuaagagaagcacuagacuuagauccuaaugcaagauuuaguggcguagcaaaagaaaaagagucuacauuagauguggcagcaagaacuggcggagccgcauauggaacuaaaacuuuaaaagaugcacugggggaugcgccguggagaucuuuaaguagaaugccugaaaaguuggaccggauagcugaaauauuaucuuuccgagaagauaugaaagccauaaggaacggucuggaagaagucgggcuugauggauuagugguugacgcacuaaugcaagcaacggcaaauggagauuuuaaagauuucacaagagcagcacacauaagcgcgcuugccgcaaggaacauaauuccuggauuaagagaaggauuaguauacagcgaugcaugcacaagaguaggauaugaucaugcagcacgaccggcagugccccuaucccaaaucgguuccccaguuacaagaaaggcuuuaagugaagcauugaagcaagugcgggcgguagcaagagaauauggacccauagauuauuuucacaucgaacuagcaagaagcaucggcaaaucagccgaagaaagaaagaaacuaaccgacggaauagaagcgagaaauguagagaaagaaaaacgaaggaaagaagcugccgagcaucuaggucgggcaccaucggaugaugaauugcuaagauacgaauuagcaaaagaacagaacuuuaagugcauauauucaggagauccuauagacccagccgggauaucugccaaugacacuagguaucaaguagaucauauauuaccguggaguagauucggagacgauaguuaugucaauaagacacuauguacugcuagaucaaaucaaaacaagcgaggacgcacaccauucgaaugguuugacgcagauaaaacugaagcugaauggauggaauauagugcaagagucgaggaucuaaaagaaguaaagggucgaaagaaaagaaacuauucuauaaaagaugcggcaucgguagaagacaaauuuaaagcaaggaauuuaacagacacucagugggcaacaagacuguuggcagaugaauuaaagcgaauguuuccuccaagagaaugugaacgaguaguaacuguaagagcagauggcggaaaugauggacuaucgauagucgaagaaagaagaguauucacaagaccaggagcaaucacaaguaaacuuaggagagcauggggacuagagggauuaaagaaacaagacggaaaaagaguagaggaugauagacaccacgcagucgacgcauuagucuuagcggcuaccacugaaucacuacuaaaucgguuaacaguagaaguacaacagcgugaacgagaaggacgacaagacgacauauuucauuguagucaaccauggccaggguuucgaguugacguacagaggacuguauauggaagcgaaacaaugccaggaauauucgucucaagagcagaaagaaggagggccagaggaaaagcacaugacgcuacugugaaacaaauacgagauauugacggagagagaauaguguucgagcgaaaaccaauugaaaaacucacugauaaagauuuagaacguauacccgucccugaaccauauggaaaagcagcagauccuaaaaaguuaagagaugaauuaguagaaaauuuaagagcuuggauugccgcuggaaaaccuaaagauaaaccaccaagaaguccgaaaggagauauuauuagaaaaguuaggaucgaaacaaaagauaaagucgcgguggaaauaaauggaggaacuguagaucgaggugauauggcacgaguagauguauuccgaaagaaaaauaagaaaggaguaugggaguuuuacguaauuccgauuuacccccaucaaauaguagcgagugcccuacccccaaauagagcagugauagccuauaaagcugagucagaauggacugcgauugaugguuguuuugaguucgcauggucauuaaauccaaugucuuauuuagaauuaguaaaaaguaauggggagcuuauagaagguuauuuuagauccauggauagaacuacuggugcaaucaauuuaucaccgauguccaccaacagcgaaacuauaagaucaauaggcguaaaaacauuguccagcuuuagaaaauucacaguagaucgacuuggucgaaaauucgaaauaccucgcgaaguccgaacuuggagaggggaggcauguacauga

SEQ ID NO: 4989 - RNA, 3195 nt, Artificial Sequence
  Cas9 variant
augaaacgaaccuccuugagagcauauagacuaggagucgaccuuggugcaaauagucugggaugguuugucguuuggcuagaugaucauggucaaccagaaggacuaggaccaggaggaguaagaauauuuccagaugguagaaauccccaaucaaaacaaaguaaugcagcugguaggcgacuagccaggagugcaagacgacgaagagaucguuaccuucaacgucgaggaaaauuaaugggucuguuagucaaacacggguuaaugccugcagaugaaccagcacguaaacgcuuagaaugucuugacccuuauggacuucgagccaaagcauuagacgaaguacuuccuuuacaucacguagguagagcauuguuccaucuaaaccaacggagaggacuauuugccaauagagcaauagaacaaggugacaaagacgcaagugcgauaaaagcagcagcaggacgucuacaaacaucaaugcaagcaugcggagccagaacauuaggugaauuucuaaauagaagacaucaguugagagcuacaguacgagcuagaucaccaguggguggugacguccaagcaagauacgaguucuauccaaccagagcaaugguagaugcagaauuugaagcaauaugggcagcucaagccccacaucacccaacaaugacagcagaagcgcacgacaccaucagagaagcaauauucucacaacgagcaaugaagagaccaaguauaggaaaaugcucacuagacccagcgacuucacaagaugacgucgauggauucagaugugcguggucacauccacuugcccaaagauucagaauauggcaggauguaagaaauuuagcaguugucgaaacagguccaacaucaucaagauuggguaaagaagaucaggacaaaguagcuagagcacugcuacaaaccgaccaauuaaguuuugacgaaauacggggauuauuaggauuaccaucagaugcgagauucaaucuugaaucugaccgucgagaucacuuaaaaggggaugcaacaggcgcuauacuuucagccagaagacauuuugguccagcuuggcacgaucgcucauuagauagacaaauugauauaguugcacuucuagaaucagcucuagaugaagcugcuauaauugcaucucuugguaccacacauucauuagaugaagcagcagcucaacgcgcauuaucagcauuauugccugauggauauugucgguuagguuuaagagcaaucaagcgaguuuuaccauuaauggaagcuggacgaaccuaugcugaagcagccucagcugccggauaugaccaugcuuuauuaccugggggaaaacuaucaccaacaggcuaccuaccauauuauggucaauggcuacaaaaugauguaguuggaagugaugaugaaagagauacuaaugaaagaagaugggggagacuaccaaauccaacugugcauauagguauuggacaacuacgccggguaguaaaugaacuaauuagauggcacggaccgccagcugaaauaacagucgaauuaacaagagauuuaaaauuaucaccacgaagauuagcagaacuugaaagagaacaagcagaaaaucaacgaaagaaugauaaacgaacaucuuuauuaagaaaacuaggacuaccugcauccacacauaauuuauuaaaacuaagacuaugggaugaacaaggcgauguagcuagcgaauguccauauaccggggaagcaaucggacuugaaaggcuagucuccgaugacgucgauauagaucaccuaauaccauucagcauaaguugggaugauagcgccgcaaauaaaguaguuuguaugagauacgcaaacagggaaaaaggaaauagaacacccuuugaagcauuuggacauagacaagggagacccuaugacugggcugauauugcugaaagagcagcuagauugccuaggggcaaaagauggagauuuggacccggagcacgagcucaauucgaggaauuaggagauuuucaagcuagacuguuaaacgaaacuagcuggcuagccagaguugcaaaacaguacuuggcugcaguaacgcauccucaccgcauucacguacuuccaggcagacuuacagcacuacuacgagcaacaugggaauugaaugaccuuuugcccggaucagacgauagagcugcaaaaucacgaaaagaucauagacaucacgcaauugaugcacuuguugcagcacugacagaucaagcacuucuaagacgaauggcaaaugcucacgaugauacaaggagaaaaauagaaguacuucuuccguggccaacguuucgcauagacuuagaaacaagguuaaaagcuaugcuagucucacauaaacccgaccauggauuacaggcaagauugcacgaagauaccgcauacggcacaguagagcacccugaaaccgaagacggcgccaaucuaguauaucgaaaaaccuucguagauauauccgaaaaagagauagaccgaauccgagauaggagacuaagagacuuaguacgugcucauguagcuggagaaagacaacaaggaaaaacacuuaaagcugcaguacuauccuucgcacagagaagagacauagcaggucauccaaacggaaucagacauguaagauuaacaaaaaguauaaaaccugauuaucuuguaccaauuagagauaaagcaggcagaaucuacaagucauauaacgcaggagaaaaugcauuuguagacauauuacaagcagaaucuggaagauggauugcaagagcaacgacaguuuuucaagcuaaccaagcaaaugagagccaugacgccccagcugcccaaccaauaaugagaguauucaaaggggauauguugaggauagaccaugcuggagcugaaaaauucgucaaaauuguaagauugucaccaucaaacaaccuauuauauuuaguagaacaucaucaagcaggaguuuuccaaacacgacacgacgauccugaagauagcuuuagauggcuuuucgcuucauuugacaaauuaagagaguggaaugcugaauuaguaagaauagauacguugggucagccauggaggagaaaaagaggauuagaaacaggauccgaagaugcaacaaggauuggauggacccggccaaagaaauggccuuga

SEQ ID NO: 4990 - RNA, 3198 nt, Artificial Sequence
  Cas9 variant
augaauaaagacauaaauuacgcacuaggauuagacauagguauuacaucugucggcugggcuguaauuaacuuagaucuaaauagaauagaagaucugggaguaagaauuuuuaacgcagcagaaaacuuaaaagacggaucaucauuagcccuaccacgaagacuagcaagaggacgaagaagacuacucagaagaaaagcguauagagucgaaagagugcgaaaauugauauuaaagaacaauauauuaacaaaagaggaacuagaaggauuauucaaaaauaaagaagugauugaugugugggaagcgagaguaaaagggcuagauuacaaacuaagucgugaagaaugggccaaaaucuuaauaaauuuuugcaaacguagaggauucaaaaguaacaggaaaaacgaagcuaaagauaaagaagcaggccaaauacugucaucaauaaguuacaacauagaaaagaugaaagaaacaaacucgagaaccauaggcgaauacauauacaaugaaguuaaaaacagugaagacaguuaugccccacuuagaaacaaauuuggagaauauaaaauguguguaagccgagauguaaucagagaagaaauacauacgcuauuugaaaaacaaagagaauuaggaaacaacuucgcgucagaugaaauagaagacaaauacuucgaaauauucaacagccaaagacccuuuagcaacuuugaagaccuagaaaaacugguagguuuuugcacauucgaaagaaagaaacauaaacgagcaccaaaacacugcaucagcuccgaggaguucacguuauaugaagggauaaauaaacuuuccauaauaaaagauggagagaaaagaaaauuaagugaagaagaaaggacgcuaguggucaaugaagcauuuaauaagaaagaaaucaaguacacaacacuucgaaaauuauuaggguuaagugaagaagaauuauuuucaacacuaacauauaguauagacaaagauauuagcaaaaccgagaacacaaaguucguaucacucaaaggauaucacgaaaucaagagagcgauagaaaaaggaguaucaaagaaagcguggcaagauauagagaacaauagaaaucuacuaaaugauauugcauauguauuaacauuaggaaaaacagaugacgaaauugaaaaacaacucagauuaagaaaugugccugaagaauuauuugaaagucuauuagauaugagcuucaacaaauucaauaaucuaaguauauacgcacuagagaaaauccuaccauucaugaaagaagguuaucaguacaacgaggcuugcgaaaaagccggauacaauuuuaaagccauauacgaagguguaaggacaaagaaauugccaguuauagaaauagacgaaauaguuaacccuguaguaaauagagcauuagcacaaaccagaaaaguaaucaauagcgugauagacaaauauggaaguccgguaagaauaaacaucgaguuagccagagacuuagccaaaaauuuuaaagaucgaaaacucauagaaaaagaacaaaaagaaaaucgugcgaaucuagauaaaauaagagagaaucugagggaauuaauggacaaagaaccaacaguugucgaaguacuaaaauaucgauuaugggaacaacaaagaggcgagugugcauauacgcaaucacaaauaccacuagagagacuauuuagucccggauacugcgaaaucgaccauauuauaccguuuaguagaaguuuugacgauagcuuaagcaauaaaauauuaguacucggcagcgaaaaccaaagaaagggaaacaggacaccauaugaauacuuuggcgaagauagugaaagauggaauaguuuugagaucugggucaaaggaucauaucuaaauuauaaaaagaaagccaaccuacuaaagaagaaauucucagaagaagaacaaagggacuggaaagcaaggaaccuacaagauaccaaauauauuugucguuacaucaguaauuucguaaacaauagacuagaguucaaagaaucggagaacaaacagaaagucauaaccgugaauggacgugcaacagcguauuuacguuccagauggggccugaacaaaguuagagaagacggugauaaacaucaugcauuagaugcagcaguaguaggaguaacaacacagggaaugguacagaaaauaaguaaguacagcaaggcacaugaauuguacacaguuaggaaaaaugaugaguucgucgacguggaaacuggcgaaugcguagacguggaugaauacaaagaaaucagaaaagacaucuuaccaagaccuuggagaggauuuucggaagaauugaaauuaagacuaagcgauaauccgcucgaagaauuaaagaaaaguccgauagaaacguauaacgaagaguucauaaaagaaaauguaaaaccuauauuuguaagcagagucccuuuuagaaaaauaucuggaaaauuauucaaagaaacgauauauagugaaagagcuuuuaaagacggauauuuuguaaguaaaaagagcuuaguagaucuuaaacgaggagaccuagacaacuucuacaacuaugaaugugauaagaaacuauacgacgcuauuuccgaacgcaugaaagaauuuaacuacaauggaaagaaagcguucgaaagccccuuccgaaaaccaacaaaaaguggaaaagaagguccaguuguaaggagcguaaaaauaaaauccgcaguaccauuuaaagaugggauccccaugaaugagggacugguugcgaaagaaggaauggugcgaauagauauauacgaaaaagaagguaaauauuuuguagugccgguauacagauaccaauuagcuaaaggaauaguaccuaaaagagcggcaauagcuaagaaagaugaacuuaaauggccuauaauggaucagacuuacaauuuuaaauucucaaucuacaaaaaugacuuaauagaaguuaaauaugauaagaaagguguauauuucgguuauuaugacggcuuugauagaaacucagcgagccuaaccauagaaaaacacgauaauagcgaaagauacagaucuauaggguuaaaaguaggaguauuggaaauaaauaaauaugaaguggaugucuuagguaacuaucacaaaguaaaauuaggaggaaauuga

SEQ ID NO: 4991 - RNA, 3198 nt, Artificial Sequence
  Cas9 variant
augaacaaagauauaaauuacgcacuagggcuagauauaggaauaacaaguguagguugggcaguaauaaacuuagacuuaaaucgaauugaagauuuaggugugcgaauuuucaacgcagcugaaaacccuaaagacgggucaucacucgcacuaccuaggagauuagcaagggguaggcgaagacuguuaagaagaaaagccuacaggguagaaaggguuagaaaacugauagugaaaaacaauauucuuacaaaagaagaacuagaaggccuauucaaaaauaaagaaguaauagauguaugggaagcaagaguaaaagggcuagacuacaaacuaagccgugaagaaugggcaaaaauauuaaucaacuuuugcaaaagacgaggauuuaaaucaaaccguaaaaaugagaccaaagacaaagaagcuggacaaauacuaaguucaauuucguauaauauagagaaaaugaaagaaacaaauucacgaacaauaggagaauacauauauaacgaaguuaaaaacagugaugacuccuaugccccgcuaagaaacaaauucggagaauauaagauguguguaucacgagauguacuaagagaagaaauucauaccuuguucgaaaaacaacgagaauuagggaauaauuuugcauccgacgaaauagaagauaaauacuuugaaauauuuaauucccaaagaccauuuagcaacuuugaagauuuagaaaaguuaguaggauuuugcacuuucgaacguaaaaagcacaaaagagcaccgaaacacuguaucucgagcgaagaauuuacauuauacgaagggauaaauaagcuaagcaucauuaaagauggagagaaaagaaaauuaagcgaagaagaaagaacccuaguaguaaaugaagcauucaauaagaaagaaauuaaauauacaacacucagaaaauuacucggccucagcgaagacgaacucuuuucaacauugacauacucgauagacaaagauauaagcaaaacagaaaacacaaaauucguuaguuuaaaaggauaucacgaaauaaaaagagcaauagaaaaaggaguaucgaaaaaggcauggcaagauaucgagaauaauagaaaucuacuaaacgacauagcauacguucuaacacucggaaaaacagaugaugagauagagaaacaauuaagacuccgaaacguaccagaggaacuauucgaaucgcuuuuagacaugagcuucucaaaguuuaauaacuuaucaaucuacgcacuagagaaaauauuaccauucaugaaagaaggcuaucaauacaacgaagcaugcgaaaaagcgggauacaauuuuaaggcaauuuacgaagggguucgaacuaagaaacucccagucauagaaauagaugaaauagugaacccaguaguaaacagagcacuagcucagacaagaaaaguaauaaacagugucauagacaaauauggcaguccgguaaggauaaauauugaauuagcaagagaccuagcuaaaaacuuuaaagaccgcaaacuaauagaaaaagaacaaaaagaaaacagagcaaauuuagauaaaauaagggaaaaccuacgagaacuaauggauaaagaaccgacagcuguagaaguauuaaaauacagauuaugggaacaacaaagaggagaaugugcauacacacaaagucaaaucgcuuuagaaagacuauuuagcccagguuacugugaaauagaucacauaauaccuuuuucccguaguuucgaugauaguuuaagcaacaaaaucuuaguguuaggcuccgagaaccaacggaagggaaauaagauaccguacgaauauuuuggagaagauagugaaagauggaacagcuucgaaauuuggguuaaaggaagcuacuuaaauuauaaaaagaaagcaaaccuucuaaagaagaaauucaccgaagaggaacaacgcgauuggaaagcaagaaaucuacaagauacaaaauacauauguagguauauaagcaacuucguaaauaacagauuagaguuuaaagaaagugagaacaaacaaaaagucauuacaguaaacgguagagcuacagcuuaccuaagaaguagauggggauuaaauaaaguaagagaggacggagauaaacaucaugcucuagacgcagcuguaguaggaguaacgacccaaggaauggugcagaaaauaucaaaauauuccaaagcucacgaacuauauacuguccggaaaaaugaugaguuuguagacgucgaaacaggagaaugcguugacguugaugaauauaaagaaaucagaaaagacauacuaccuagaccauggagaggauuuucggaagaacuaaaauuaagauuaucagacaauccgcuagaagaguuaaagaaacuaccgauagaaacauacaaugaggaguuuaucaaagaaaauguaaaaccaauauucgugagucgaguaccauuuagaaaaauaagugggaaacuguucaaagaaacaaucuacagcgaaagggcuuucaaagauggauauuuugucaguaagaaaagccuaguagaucucaaaagaggagaccuagauaauuucuacaacuaugaaugcgacaagaaauuauacgaugcaauaagcgaacgaaugaaagaguuuaauuacaaugguaagaaagcauucgaaagccccuuccgcaaaccaaccaaaagcggaaaagaaggaccgguuguaagaaguguaaaaaucaaaucugcagccccguucaaagacggaauaccaaugaaugaaggauuaguagccaaagaagggaugguaagaaucgacaucuaugagaaagaagguaaauauuuuguaguaccaguauaucgguaucaacuagcaaaaggaauuguaccaaaaagagcagcaauagcagggaaaucggaauuaaaauggcccauaauggaccaaacauauaauuucaaauucagcauuuuuaaaaaugaucuaauugaaauaaaauacgcaaagaaagauggauacuuuggauauuacgauggauuugacagacacacagccagcuuaguuauagaaaaccacgauaauuccgauagauaucgagguaucggcguaaaaacaggaguaguagaguucaacaaauacgaagucgauguucuaggcaauuaucauaaagugaacuugggagguaauuga

SEQ ID NO: 4992 - RNA, 3201 nt, Artificial Sequence
  Cas9 variant
augucagaacgaguuguacggagaauauuagggauagauuuagguauagcauccuguggauggggaguaguagacauaucuggcgcugguggaggcauaaucgcaacagggguuagauguuuugaugcaccacugauugacaaaacaggggaaccuaaaagcgcaacacgacgaacagcaagaggacaaagaaggauaguacguagacgaagacagcguaugaauggaguacgaagauuguuaugcgaauuugguuuguuacccgacccaagacccgacgcauuaaaucaagcuaugcguagaaucaguacagcaucagcagcagcgcaaguaacgccauggacacucagagcagcugcacaccaacgccuguuaaguaaugaagaacuugcaguaguauuaggucacauugcuagacauaggggauucagaucgaacgcuaaaaaugaagcgggagcaaacgcugcagacgaaaccaguaaaaugaagaaagcaauggaagcaacuagagaaggacuagccaaauaucaugcauuuggagauaugauagcaaaugauccuaaauucgcgaaucgcaaaagaaauagagacaaagacuauucacacacagcaaaaagaagcgauuuagaagaugaagugagagcuauauuacgagcacaacuuagauuugguagugcagcugcaacggaaaccuuagcacaaacauuugcagacguagcuuucuuccaacgaccauuacaagauucggaggauagaguaggcgauuguccauucgagccaggacaaaaacgagccgcuagacgagcaccaaguuuugaauuauuucgauuuuugucgagacuagcgaaucugaaacuagcugugggacgaaguccugaacgacgacuuacggcagaggaaauagcuuuagcagcgaaaggcuucggagaaacuaagaaaacaaucacguuuaaaucacuuagggaagcauuagaucucgacccgaaugccagauucagugguauaggaaaagacaaagaagcaucauuggauguaguagcaagaacaggcggcgcugcauacggaaccaaaacacuaaaagaugcgcuuggugaugcuccguggagaucacuuagccgaaccccugaaacguuggacagaauugcugaaauacuaucauuucgagaagauaucacaaguaucagaaauggacuagaggaucuaggguuagacucauuaguaguagaagcauuaaugcaagccgcggcaaauggcgauuucaaagaguucacaagagcuggacauauaucugcgagagccgcccgaaacauaauaccaggccuacgagaaggucuaguauauucagaagcaugugccagaguaggauaugaucaugcggcaagauuaucagugccauuagaucaaguaggaucucccguaacaaggaaagcauuaagcgaagcacuuaaacaagucagggcaguagcaagggaauauggaccgaucgauuauuuucacauagaacuggcuagauccguagguaaaagugcugaagagaggaaacaauugaccgacggaauagaagcccgaaauguugaaaaagcuaaacggcgcaaacaagcggaggaacaucuugguagagcaccaucggacgaugaauuauugagauacgaacuagcaaaagaacagaacuucaaguguauauauucaggagacgcuauagacccagcuggaguagcagcaaaugacacaagguaccaaguagaccauauauuaccuuggucaagauuuggagaugacucuuacuuaaauaaaacgcuauguacugcaagaagcaaucaaaauaagagaggucggacuccauuugaaugguuugaagcugauaaaacagacguagaauggauggaauacguagcaagaguugaaaacuuacaagaaguuaaaggucgaaagaaaagaaacuauucuauuaaagaugcggcagcaauagaagauaaauucaaagccagaaaccuaacagacacacagugggcaacaagauuauuagcagacgaacuaagcagaauguuuccaccaagagaaugcgagagagcgauuugugguagggcagacggaggaaacgacggauuaaccauagucgaagagagaagaguauuuacaagaccaggugcuaucacaagcaaauuaaggagggcauggggguuagaaggauuaaagaaacaagacggaaaacguguagaagacgaccgacaucacgcaguggacgcccugguauuagcggcgacaacagaaucauuauuacagagacuaacuguagaaguacaacgaagagaaagggaaggacggccugaugacauuuuccauugcgccgaaccauggagaggguuuagagcugaugucagacgcacaguuuacggaagugaaacgaugccaggaauuuuuguaucaagagcagaacguagacgagccagaggaaaagcacaugacgcaacaauaaaacaaauacgugaaauugaaggagaaagacucguauuugaaagaaaaccuguggaaaaauuaacugauaaggauuuagagaaaauuccuauuccaaaacccuauggucaaguuucagaccccaaaagguuaagagaugaauuaguagaaucucuacgugcauggauagccgcggggaagccuaaagacagaccaccguuaucaccaaaaggagaugucaucagaaaaguaaggauacaaacgaacgacaaaguaagcguugaaauuaauggaggaaccguagaucggggcgacauggcgagagucgauguguucagaaagaaaaauaagaaagcgguaugggaauauuacguaguuccaauauauccacaccaaauaguugcguuaaaugacccaccagaucgagcuguuauugcuuaugcugaagauaaagauuggaaagaaauagauaguagcuacgaguuccuguggucauuauucggauuaagcuacguagaaaucaguaaagcuaauggcgaaugcauugacggguauuucaggggauuacaucgagguacaggagcugcuucaguaugcaaacacauuagcuuaggaaaagaugcuacaguuagcggaauaggccuaaaaacacuugcaucauuuaagaaauuuacaauagacagacugggaagaaaauucgaaauaccacgggaaguaagaacauggagaggagaggcuugcaccuga

SEQ ID NO: 4993 - RNA, 3201 nt, Artificial Sequence
  Cas9 variant
augucacaccuagucuuaggacuagauuuaggaccaaauucaauaggaugggcguuaguaaaugacgacccggaacauccgguagaaucaaaauuaguugacuuaggaguuagagucuuuccagaaggagucgauaacuuugacacaucuaaagaauugucacguaaugaagauaggagaguggcaaggggaaugagaagacaaauaaggcgcagagcaagaagaagacaacaauuaaaacaagcguuaauagauucaaaacuauggcccagugacccuaaugaugaaguuguucuauacaauacaaauccauacgaauugagagcgagagcacucaaagaacggcuagaaccacacgagguugguaggguauuacuacacuugaaucaaaggagaggauuccugagcaauagaaagaaagacagaggggacaaagaaguacaaggaauguuagcagaaauaaaugaaaacgaacaacaauguaaagacggaggguuugacacuauaggugcuuggcuagcugacaaacaagcaaauauagaccaugcuaaccgagaagagaacgaucaugucagaaauagacaccuagcgagaagucaguacguagacgaguuugaagcuauuuggaguguucaagcaaaacaucauccgaaacuacucacagaagaacuaaaaguuggcaaauuaggaaaacaaacuuacccagucaaaccgauaccuagauggcaugaacauagacaagggcuauccccacuagaaucuuuuggaauauauggucucauauuuuuccaaagaccaauguauuggccgaaaucaguaguaggacuaugugaacuggaaccaaaagagagaaggugccagcgaagcgaucguagacaacaaagauucagacucuuacaagaaguaaauaaucuaaaauacguugauccugauacacauuuagaacaaaaauuagacgacaaacaaagacgauuauuauuggauaaacuuagccauacuaaagaaaugacauuugaccaaauacgaaaagcacuagacuucuuagaaucuguaaaauuuaaccucgaacgaggggaaagaaguagacuaaaagggguaccuauagaugcacuauuugccgcaaaggacguacuagggcaagagugguaugacagaccugaacaacagaaaaccgaaauaguagcaguauuacuagauaacgaacgggacgacgaucgaauaaucgcaagagcagucgcagaguggggaaugacagccaaggaagccgaagcaaugcuuggugucgaccugccugcaggguaugcgaacuuaaguuguaaagcuauagaaaaacucuuaccgcauauggaaagaggucuacucuauauggacgaugaugaaucaaauucagcuaugcaugcagccggauacuuacgacgagaccaacuacguagaagaauuuucgauguauuacccgauccggcaagaacaccaaacuguccaauaggcgauauaccaaauccaguaguaaaaagaacccuaacugaaauuaggaaaguaguuaaugcaauaguaagagaauauggaaaacccgaugccauacauuuggaacuagcaagaucaguacaaaugggaaaggagaaaagaucagaauauucaaaaaugauucgggacagagaagcagaacgcgauggaauaguagaaaaguuaagagaaagcggaguaagggugacaagagacaacauacucaaguaccaguuaugggaacaacaaaaucaagaauguauuuacaguggcaaacccauuagcuuugaaaaauuauuuggggagggaggugguguagaaguagaucauauacuaccccgcucuaggucacuagacgacagucaagcaaauaaaauagucugccuaagaacggccaacgcuggaaagggcgaucagacaccauaugaguggcucgccgauacacagccaaaacaauacgaacaagugugccaaagagcagggauguuaaugaggaguggaagaaugccauaugcgaaauauagaagauuuauucaaagagaacuugaacucgacaaauuuauagcaagacaauuagcagauacaggauauauaacuaaagcgacaauggaauaccuaagguaccucuuugauaaagaccaugauguuuuaggauugaagggacaacuaacagcagagcuuagauaucacuggggucucgaaacaauacuugaagaacuaccagauucuccagcauggcaugaagcugacaguggaaaauuaagaccaggugagaaaaacagagcugaccacagacaucaugcuauugaugccguaguuauugcucuaacaaauagaagacgacuuguacaacuaucugauauaguaaaacguggaggagcacgggcacauggagaaaucuuagaagacccuuggccaaauuuuagagaaaauguaguccaagcuauaaagaaaacaaacguaucacaccgaguagaaagaaaaguugcaggaaaauuacacgaagagacauuauacgggccaacacgaacaccaggggaauggguacuaagaaaaccugucauagcucuaucugcaaaugagguagaaagaauuagagaugcuacgauuagacaaauaguagugagcgcacuagcagaugcugguauugaugucgggcgaggaaagaaaccagacgcuaagaaaaugaaagaagcauuaucaaaauuaaaaaugccuaguggaguuccaauacgaaaaguacgucuaacaaaaccagaacagaccauacaaccuguaagagccggcagaccugaucaggcuuuugucaagccugguaguacacaucauuuaugcauuuuugaauuuacagaaaauggaaaaacaaaacgagaugcaguauucguaacaaugcuagaagcaaugaacagacuaaaacgacgagaaccaguaauacaaaggacucaucccgaacgcccagacagccgauuuguaaugaguuugagcgcaagagaaaugcuacuugccaacuggaaagauggugaaagauuauuaacauucaaaacagcaaguagcacucaaggacaaauuugguucgcugaacacacagaugcuagaaaaucagcagauuauaagcaauuuguugcgaacgcaaauacccuagaugcaaagaaagucacaguugauccauuaggcagaauccggugggcaaacgauuga

SEQ ID NO: 4994 - RNA, 3204 nt, Artificial Sequence
  Cas9 variant
auggggacuagacuaggacucgacauuggcacaaauucgauugguugguguuuauuuaaccucgacggaaguggaaggccuauaggaaucagagauauaggaguuaggauauuuucagauggucgggauccaagaaguggugcuagucuugcaguggagcgacgaguagcuagagccaugcgaagaagacgugaccgauauauuaggagacguucugccuuauuggaagcauuaauuaacacaggcuuaaugccugcggauguacaagaaaguaaagcauuaacaggaugugauccauauguucucagagcucaggcacuagaucgagcauuagaugcacaucuacuaggaagaguauuauuucauuuaaaucaacgaaggggauuuaaaucuaauagaaaagcagaaagaaaagcaggcgaugauaaagaagggggaaaaauagcggacggagcaaaagcacuagaucuugcaaugcaugaagcgggagcaagaacauauggugaguuccuugccggacgagauagcaggagaguaagacuuagagcagaaggagacggauaugauuucuacccagaaagaagacauuuagaagcagaauuugaugcaauaugggacgcccaggcugcauacaacccugcccuuuuaacugacguagugagagacagauuaagaagaauaauauucuuucaaaggccacuuaaagcaccaaagguaggaggaugcaccuucuuuaaugaggaaccacgauuaccaaaagcacacccccucuuucaagaaagaagacuauaugaagaagugaaccaacuagaaauaacaagggcuggagcaccuucaagaaaacuaacauuagaucaaagagauaaaauaauuaggaaauuaaaaagugcaaaaacagccucuuucucaggacuggcacgacuguuaaaguuagcagauggugaaucauuuucaagaguaacagaaaauagaacagggcuagcaggagaugauauauuuacgucauuuagugauaaaagauguuucggagacagaugggcacauuucgauccgggaguucaauggucuauaauagaaaccguuacagaagaagaggauccugucagauuacgagauugguuaauggcuacacauggagucacaguugaacaggcagaagcaaucgggagaguacgccucccggaaggacacgggagacuuggagaaacagcgaguagacuuauacuugcucaauuaaaaucaggcagcaaagauggacacccuuuaacauauaacgaagcaguagaagcugcucuagguaaaucgcauucugauuuuaggacaggagaaauauuagaacaauuaccauauuauggugaaauucuaucaagagaaaucccacccggaaguuuagauccugaugaugaugaugaaauaagguggggaaagauaacuaauccaacaguacauaucggccuuaaucaacucaggagacugcuuaaugcuuuaauaaaagcacauggacgcccagaugaaauaguaguagaauuggcacgagaguuaaaauugucagaaaaagacaaggcugagcauaauagaaggauaggagcgaauacccgagcugcggaagcaagaucaaagaaauuacuagaaaguggccagccggauacuggugcaaacagaagccuccuaaaacugugggaggaucuaaacccaaacaacccuuuagacagaugcuguccuuuuuguggaagacacauagggcagauggcucuauuuaguggcgaaacagaaauugaacauauaauaccauacagcagaucguuagaugacagcgcggcaaauaaagugauagcucaccgcaguuguaacagagagaaaggaaacagaacaccaugggaagccuggggucauacagaacguugggcaauaauagcagaacaagucagcaggcuccacaaaucgaaacaauggagauuugcaccagaugcuauugagagauuuaaucaagaaggaggauucauagcaagacaacuaagugauacacaauauuuaagccgaauggcaaggacauauuuaucuucauuauauccggauacagcggguguauacguaauaccggguaggaugacggcaaugcuacgacgucugugggguuuaaacgaauuauugcccgaucacaauuauguugagaauccgcauaguggagcaccgaaaaacagauuagaucaccggcaccaugcgauagaugccgccguaguaggugucacuacaagaggauuacuaaaugaaauaucaagagccgcuggacgagccgaacggcaagacuuggacagacucuucaucgaucuaccaaaaccaugggaaaccuucagagaagaucugcacgaaaguuuagcgagaguuguuggaucucacaaagcagaucauggccgaaaaggaguaccagcaaaaggaaaagacgcaaccgcagcuagacuacauaaugaaacagcuuacggacucaccggguuaaccagugagaguggucuuccaauuguaguacauagaguaccauuacuaucucuaaaaccugaugauuuaagcaauccaauaagaauaccugaugcagcauuacaacgggcucucagagaggcuaccgacgguaaaagcggaaaagauuuccaagaagccuuggcucaauucaguaaauccgacccuguauuuaagggaauaaggcauguaagggugcgagaaacacuaaaaguaauaccaauucgagaugcaucugggcaugcguuuaaagccuauaaaggagaugcaaaugcucgauaugauguauggagaaugccagauggaaaauggguuucaaguuggagagauagagaugguaaagcccauagcggaauaauaacuauguuugcagcacaucaagcaggucaaccaguacaaaggccucacccagcugcuaaaagaguacuuaguuuaagacaaaaugaucucguggcuguagaaccucaaggccaaccaagaaaaauuaugagaguuguuaaguuuucaaguggcggacagauaacguucgcagaacaucaagaggcaggaccacuaaaagcaagggaugcaaccaguccagauauugauccuuucaaauauuuuuacucuucugcugguggucuacaaaaagcgagggcaagacaaauacgaauagaugagcuuggucgaauuuucgacccaggccccagauga

SEQ ID NO: 4995 - RNA, 3207 nt, Artificial Sequence
  Cas9 variant
augaaauauguucucggacuagacauagguauagcaucaugcggaugggcgguuauaaaccaggaaaaacacagaauagaggacuuaggcguucguauauucgauaaagcagaaaacccaaaagauggaaagucccuagccacaccaagaagagaugcucgaucaacacgaagaacucuaagaagaaaaaagcaccgcaugcaaagaaucaagauacuccugguuaaacaugggcuucugucaaaaacagaaauagaucacuuauacgagagcgcaacugaaauugaugucugguaucuaagacucaaugcacuagaacgacggcuaaacccuaaggaauucgcuagaguauuaauacacuuaaguaaacguagaggcuuuaaaagcaacaggaaagaaacaacccucucagaaaauggacaaauacuugaaaacauauccgaaaaccuacaaauaauggaacaaaaaaauuauagaacaguuggggaaaugauucucaaagauaagagauucgaaaaucacaaaagaaacaaagauggcacauacauaggaacagucacacgacaacaacuacaagaagagauacaaaugauauuuaaugcucaaagacuauauaaaaacaaucacgcaacugaaaaauuugaaaguaguuaucucgaaauuugggcaucucaacgacccuaugccucuaaagaccaaauugaaaaaaugauaggguacuguacccucgaacccaaagaaaaacgaguacccaaagccucauggucauuccaauacuucgucgcacuccaaacaauaaauaaucuaagacuaauaagcaaagauagaauagaagaacucucauucgaagaaaaaaaacgaauaaugaaccuagcauuagaaaaauccauaguuaaauauauagacauaagaaaacuauuauccguaccaaaagaguuucaauucaacagucucuccuauucagcagacauagucgauacaaccguagaaaacaaaaaauguauagaacuaaaagaguaucacuccaucaacaagguauauaaacaaaucuauggacaaaaugcacuaaaccuacuaccgaaagauuaugacacaaucgcauauggacuaacaaucuucaaagacgacaaagauauacaagaauaucuacaaaauaaauauguaaaugcaaaaggaaaacccauuucaaaucuagcaaauaaaacuuacgacgacacauuuauacaaguccuccuuacacucaacuucagcaaaaugggucaccucuccuucaaagcccucaaaaauauaaucccuuucuuagaagaaggacucaguuacgacaaagcuugcgaaaaagcaggauacaacuuuaaaggcacaucuuauacgaaaaaaacgaaauaccuccccguaauaccccaaaacacaaacccaguaguacaucgugcgcuaucacaaacaagaaaaguuauaaaugcaauaauaaaaaaauauggaucacccaaugcaauacacaucgaaacugcacgagaacuaaguaaaaccuuucaagaaagaaaagaaauagauagcauguaucaagauaacucgaaaaaaaaugaacaugcaauauguaaacuaaaagagcuaggaaacauaaacccaagugguaucaauauaguaaaauuuaaacucuggaacgaacaagacggaagauguauguacacaggaaaauacauugaaccccauagauuauucgaagagggauauacagaagucgaucacauauuaccauacucuagaucccuugacgacucauauaauaauaaaguacucacacuagguacugaaaaccagagaaaaggcaauaaaacaccuuacgaguacaugagaaacaauucuaucugggacgaauuugaaacuagaguacagucaaauaaaaaaauaaacaaaaaaaaacaacaaaaauuauugcuacagaacuucucacacgcaagagaacaagaauucaucgaacggaaccuuaacgauacgagauacgcaacuauauaccucucaucucucauucaacaacaucuaauuuuuuccgaauccucgcgagaaaaaaaaguacacacaguaucagguauaauaaccagucaccuacguucaagauggggauucaacaaagauaggaaagaaggacacauacaccaugccuuagaugccguaauagucgcaguaaccucugaccauaugauacaacgagucaccaaauauuacaaacuuaaagaauuaaacagaaauagacaagccaaaagaaugcaguucccagaaccaugggaagguuuuaggcuagaacuugaagcacguauaucgccaaauacacaacaauacuuaaaaggcauaagauucaaaaacuacgccgacguaaaccucagcgaaaucaaaccaauauucguaucacguaugccaaagcgaaguaucacaggggaacuccaucaagaaacuauuagaaaauuccucggcuauaaugaaaaaggaaaaguuuuaacagcaacaaaaacuaaacuugaagacaucccauucgacgcgaacggagacuuuccuauguuuggaaaagaaacagaccuauacacauacaacgccauaaaagaacgauauuuaucccacaaaaaagauaaaucuaaaaguuuucaagaaccauuauauaaaccaacaaaaucuggagguauaggaccacuaaucaaaucaauaaaaauaauggauacccgaacaauaguaaacccaguaaaucaaggaaaaggaguaguauauaauagcaaaauagcacgaaccgacguuuucaaaaaaggagaaaaauacuaucuaaucccaauauacacaauagaccuaaugaaaaacacacuuccccagaaagcaauaacagccggaaaaggauacgaagauuggacaacuauagauccaucauucacguuucuauuuucacuauuucccaacgaucuaauacaaauagucccauccaaaaauaaaacaauaaaagccagaacaacaguaaguaagaaagagguacuacuaccaagccuuaccggguacuucaaaggaguccacucuggaacagcaggaauaacagucgaaacccacgacggaucaauaauugcaaaugucggaagcaaacaacuauuaucauucgagaaauaccagguagacguauuagggcacuauacaaaaaucaaaaaagaaaaaagaauuggcauggcaauauga

SEQ ID NO: 4996 - RNA, 3207 nt, Artificial Sequence
  Cas9 variant
augaauaaagcaguagcauauaggcuagcacuagaucuaggauccacaucgcuagguugggcaaucuuuagacuuaacgaagcaagagaaccuaccgcaauaauucgagcaggaguuagaauauucucagacgggagaaaugccaauagugaaccacuagcaguucacagaagaguggcacgggcaaugagaaggagaagagacagacuacuaaaaagaaagaaaagaaugcaugaccaacuuguccaacauggcuuuuucccagcagaaguagcagagaggaaagaacuugaaagacuaaauccauaucaacuacgagcuaaaggucuacaugaagcguugacacccggugaguucgcgagagcauuauuucauauaaaucaaagaagagguuuuaaaagcaauagaaaaacugauaggaaagacaaugauucaggagcauuaaaacaagcuauuagcgaacucagaaaaagaauacaggacagugauugugcgacagcuggagaaugguuuuggaaagaacgaaugcagcaaaaaccagaaggaguuaggggacaauggguuagggcaagauauagaaaaacacccucaacaacagaugaagggaagaaacggauagguuaugaccuauaugucgaucgagcaaugguggaacaggaguucgaugcuuugugggcagcgcaagcugcuuugcaaccgggcuuauucacagaagcagcacgugcagaacuaaaagacacucuacuauaucaaagagaucuaaggcccguaaaaccgggacggugcacgcucuuaccggcagaagaaagagcaccacucgcauugccuucaacacaaagauuucgaauacuacaagaaguuaauaauuuaagacuacuagaugaggcuuuaagagaaguuccauugaaccuagcucaaagggaugcaguuguaucugcgcuagaaggaaagaaagaacuaucguucgcagccauuagaaaauuauugacauuaagcgggaaauuuaauuuggaagaugagaaaagagcagaauuaaaagguaaugcaacgucaguuauuuuggcacgaaaggauuuguuuggagacgcuugggcuggauuugacgcagcaguacaagaugaaauuguuuggagauuaguaucacaagaaagugaaggggcauuaauagcauggcugcagcagcacacaggaguagacggcguuugugcagaggccauaguuaauacaagguuaccugacgguuacgguagacuaucaaggaaggcguuggaaagaauaguaccagcacuacaacgugaagucuguacauaugacaaagcaguacaagcagcaggguucgcacaucacucagaucuaggauuugauuucgauuaugcugaagaugaaguacaacaaguaggagaacacacaauagcaaguacuggagaaguccaggcacaauaugcguucaaacaauuacccuacuauggaaaagcauuacaaaggcauguugccuuugguagcggagaugcaaaagaccaugaagaaaaauguuauggaaaaauugcuaacccuacaguacauauaggauuaaaccaaguuagaacagugguaaaugcacuuauuagaagauaugggcauccuacagagguaguaguagaauuagcaagggaccuaaaacaaucaagagaacaaaagcagcaaacccaaagggagcaagcugauaaucagaaaagaaaugaagauauaagaaaacgaauagcaccaauacuggaaacaucuccagaacgaguuagggacagagacauaaagaaauggauccuuugggaggaacugaauaagaaagacauugcugauagacauugucccuauaguggggaaagaauuuccgcaacuaugcucuuaagcgaagcaguagaaauagaacacaucuugccauuuagcagaacgcuagacgauucauuaaauaacagaacagucgcaaugagacgagcgaacagaauuaaaggagaccggacaccaugggaagccagagcagauuucgaggcacaaggauggcgauaugaagcuauacuccaaagggccgaaggaaugcccccuagaaaaagauauagauuugcagaagaugguuaccaacgaugguuagguaaagaccggaacuuccuagcaagagcuuuaaaugacacgagcuauuuaagucgacuagcugcuaauuacuuaagauuaguuugcccacaaggaguaagaguaauuccaggacaaaugacagauaaacuaagaggaaaauuuggucuaaauucaguacuaggauuagaugguaagaaaaaucgaaaugaccacagacaccacgcaguugaugccugcguaaucggaguaacagaccaagguuugaugcaaagauuugcaaaugcuucgaaacaggcaagagagaauggguuaacaagauugguacaagauauguuacuaccuugguggccaucauauuacgaucauguagaaagagccguuagacauaucaggguaagucaccgacccgaucacggauuugaaggcgcuaugaugaaagguacagcacauggaauuagagaagauggaauuagagaagauggaagaauaaaacagagaccaaaagcuaaaggcucagcagaccauaaaaccaucacauuaauaccaauagaugaaccacgacaauuggcaagacacgguguagaugcagagggaaaaccauuaccauauaaaggauacgcaucaggaaguaauuauugcaucgaaaucacgaaaaauggcaaagguaaaugggagggucaagugauaucgacguuugaugcauauagaaucaaagcugcagcggaugcugcggcaagggcaggucaaguaauaucaaccguagaggcagauaguauaguacgcaaaucugguugggagagguuaaggggcgcacaaucacaaaacggucagccauuggucaugagauuagugauaggcgauagcguuagaauggaagucgauggucgagaugaaguaaugagaguaguaaaaaugucuggaaaagaaauggucuucgcuccaguaagagaagcuaacguggauaaaaggaauaauaugccagaugaacaggauccauuuacuuauaccuauaaacgggcagaccaacuacguaaagcuaaagccagacaaguaacgauaaguccaaucggugaacuacgugauccaggguucaaaggauga

SEQ ID NO: 4997 - RNA, 3207 nt, Artificial Sequence
  Cas9 variant
augcaauacgugcuaggccuugauauaggaaucgcauccugcggaugggcaguaauuaaccaagaaaaagaaagaauagaagaucuagggguucgcauauucgacaaagccgaaaauccgaaagauggaaaaucacucgcggcaccacgucgcgaugccagaucaacaagaaggacauuaagaagaaaaaaacaccgaauguuaagaauaaaaauacucuuaguaaaacaaggacuccuaucgaaaaaugaacuaaaucauuuauacgaaucaacgacagaagucgauguguggaauuuacgucuugacgcacuagaaaggaaacuaaaccccaaagaauuuacuagaguauugauacaccucgcuaaacgaaggggauucaagucaaacagaaaggaaacuacacuaucagaaaaugggcaaauauuagaaucuaucucagaaaaccaacaaauaauggaacagcaaaauuauagaaccguaggagaaaugaucuuaaaagacaaaaaauucgaaaaccauaaaagaaacaaagauggaaccuacaucggaaccgucacacgacaacaacuccaagaagaaauacaaaugauauucaccgcacaaagauuauacaaaaacgacuaugcaacagaagaauuugaaaucuccuacuuagaaaucugggcaagccaaagaccauacgcuucuaaagaccaaauagaaaaaaugaucggauauugcacacucgaaccaaaagagaaaagaguaccaaaagccucuuggagcuuucaauauuuuguagcgcuacagacaaucaauaaccuacgauuaauaucaaaagaccggauagaagaauugagcuuuaaagaaaaaaagcaaaucaugaaccuagcacuagagaaaucaauagucaaauacauugacauuagaaaacuacuaagcauaccaaacgaauuucaauuuaauagcuuaucauacagcgcagacacuguagauacgacacuugaaaacaagagaugcauagaguuaaaagaauauuauucaauaaacaagguuuauaaacaaaucuaugaaaaaaaugccuuaaaccuacucccaauagauuacgacacuauagcauacgguuuaacaauauucaaagaugauaaagacauuuuagaauauuuacaaaacaaauacgugaaugccaaagguaaaccuauaaacaaccuagcaaaaaaaaccuacgacuacaccuuuauacaagcgcuucugacccuaaacuucacuaaaaugggacaccuaagcuucaaagcucuuaaaaacaucauuccauuucuagaagaaggacucucauacgacaaagccugugaaaaagcuggguauaauuuuaaagguacaucauauacugaaaaaacgaaauaccuacccguuauaccucaaaauaccaacccuguaguacacagagcacuaucgcaaacaagaaaagucauaaacgcaaucaucaaaaaauacggaucaccaaacgcaauacauauagaaacagcccgagaauuaucuaaaacauuccaagaaagaaaagaaaucgacucaauguaucaagacaauucaaaaaaaaacgaacacgccauacauaaacucaaggaauuaggcaacauuaacccauccggaaucaauauaguuaaauucaaacuuuggaacgaacaagacggaagaugcauguacuccggaaaauacauagaaccacacagacuuuucgaagaaggauauacagaagucgaucacauucuaccuuauagucgcucacuagacgacucauacaauaacaaaacgcucacauuaggaaccgaaaaccaacgaaaaggaaauaaaacaccauacgaauauaugggaaacacaagcauauggaacgacuucgaaacacgaguacacagcaacaaaaaaauuaacaaaaaaaagcaacaaaaacuccuacuccaacacuuuucauacgcaagagagcaagaauuuauagagagaaacuuaaacgacaccagauacgcuacaauauaccuaucaagccuaauccagcaacaucuaauauuuucagaaagcucuagaaaaaaaaaaguucacacaguaagcggaaucaucaccucacaucuccgaucacguuggggauuuaauaaagaccgcaaagaagggcacauacaucaugcacucgacgcagucauuguagcaguuaccucagaucacaugauacaacggguaaccaaauauuacaaacuaaaagaauuaaaccgaaaucuacaagcaaaacgaaugccauucccugaacccugggaggguuucagguuagaacucgaagccagaauaagcccaaacacacagcaauaccucaaaggauuccgauucaaaaacuacgcggauguaaaccuaagugagauaaagccuauauucguaucaagaaugccaaaacgaucaauaaccggagaacuacaccaagaaacaauccguaaauucauaggauacaaugaaaaaggaaaaguacuuaccgcaauuaagacaaaacucgaagacauaccauuugaugcaaauggcgacuuuccaauguauggaaaagaaacagaccuauacacauacaacgcaauaaaagaaagauuucuaucacacaaaaaagauaaaagaaaaucauuccaggaaccucuauacaaacccaccaaaucaggaggaauuggaccacuaauaaaaucaauuaaaauuauagacacucgcaccauagucaaccccguaaaucaaggaaaagggguaguguauaacagcaaaauagcaagaacagacguauuuaaaaaagaugaaaaauauuacuuaauacccauuuacacaauugaucugaugaaaaacauauuaccacagaaagcuaucaccgccggcaaaggauaugaagacuggacaaccaucgauccguccuucacauuucuauucagcuuguucccaaacgaccuaauacaaaucguaccauccaaaaauaagacaauaaaagcccgaaccacagucagcaaaaaagaaguacuacucccgagccuaaccggauacuuuaaaggaguacacucgggaaccgcuggaaucacgguggaaacccacgaugguucaguaaucgcuaacgugggcucaaaacaacuauugcuaauugagaaauaccaaguagauauacuuggccauuacacaaaaauuaaagaagaaaaacgaauaggaauggcaauuuga

SEQ ID NO: 4998 - RNA, 3207 nt, Artificial Sequence
  Cas9 variant
augccuaaauccgcuaaaccacaacaagccuauacacuaggucucgauauaggcaucgccucaguaggggcagcccuacuaggacaacagcauauaaucggacuacauguccgcacguuugauagggcugaaacugccaaagaaggagagccucuaaacaaaauaaggcgggacgcacgucugacaagacguagguuacaacguagagcacauagauuauuaagauugagaagauuauuuaaaaggcauaaccuaauacccgauacugacaccucuacauuuauaucaggacaaucuccaugggaacuaagagcccaaggccuagacagacaauuaaccagugcagaauggacuaccguacuauaucauauaguaaaacaccguggguuccauucaaaucguaaaagcgaaguaaaaaccgaugaaaaagcuggccaaauguugucaggcguaaaccaaaaccaagcucuacuaaaacaaaguggauuacgaacgaugggugaacuugcagcuagacacgaggcuuuccgugaagcuaaaaggaauaagaaaggugcauauaaccauacauuuagccgacaugacuuagaagacgaacuacauuuauuauuuucucgacaacgugaauuaggaaauccauacgcaacaccagaauuagaagaugccguacauacauuauuaaugcagagacgacccgcauuaucaggaaccaacuuguuaaaaaugguuggacacugcacauuagaaccagaugaauuuagagcaccaaaagcaucauauaccgcagaacgauucauaugguuaacaaaauuaaauaaccuccgaguuaguggaucuggugaaacccguccucuaaaugaauccgaaagacaggcgcuccuaagcaaacccuuuucacaauccaaauugacauauaaacagguacgaaaaauccuagaacuaccggauaauauucgauuuguaggucuacauuaucaucccgcccaagacaauggaaaaaguccagagaaucguguuuucuuugaagcaaaagccuuucaugcauugaggaacguauauaagaaagcaggauuaaaccuugaauggcaaagggacucacaaaacccagaaaaacuagauaauauuacauaugcacugacaguuuuuaaagaagauaaagaagcaaaacaaugguuaauagaaaaaggagucgaagcaucaguaauugaggcaguccugaacgagagcuucagcgaauuuguaagacuaucuaucaaagcauuacggaagauaauaccccauauggaaauuggacaucgcuacgacgaagcaguaaaauuagccggguauucacaucacagccaucuaccacaaccuucaaaaacaccuuacauaccaagguuuucaaaacagaguauagcaaauccugucgucucaagagccuuaaaccaagcacgcaagcuaguaaaugcaauaguacgagaauauggcccucccgaugcaguacauauagaacuagcacgugaccugaacaaaccuuucgaugaacgcaggaaaauagaaaaagaucaagaaaaauaccaaaaagauaaagcaagagauaucgaaacauuccaggaaaauuuugguuucacaccuaaaggacuacaacucacuaaauggagacuauauagagaacaaucaggcaaaugugcauacucacuuaaaccauuagacauaaacagauuauuugaggacggauaugucgaaauagaucaugcacuucccuauucaagaucauuuaacgaugguaugaauaauaaaguccugacacucacuacugaaaacagaaauaaaggcaaucaaacaccguacgaauaccuagauggugcaaguaacagugcccaauggagaaacuuuguagcuuggguaaacucuaacaaaucuuauagggcaucgaaacaaagaaaucuacuccgaaaagauuuugcugcacaagccgcuacagaguuccgagaaaggcaccuaacagauacaagguauaucgcccgggaguucaaacguaugguagaaacucaccuaaaacuuaacaaaccuaaccaaagaugcguagucgucuccggacaacucacggcuuauuuaagagcaagaugggguuuaauuaaaguaagagaaaacggagaucuacaccacgcauuggacgcagcaguaguagcagcaugcucacaugcaaugguaaaaagauuagcagacuauaguagaaggggcgaauugcaauacgcucgaggccaucacuuugauccagaaacaggagaaauaauagauauuaaugcauugagaaaacucgacgaccacuuuccacagccauggacugauuuccgacgugaacuauuggcauggcuaucaccagacccugcgcaacagcuaaagaaucuagcguauuauacagacgaacgauuaaaacaaguaaaaccaauaagaguaucaagagcaccgacucgacgcggauuaggugcagcccaucaagaaacaauaaggagcgcaaaauaucuaggagaaaaccguuccacagucaaaacuccccuagaaaaacuaaaacuuaaagacauaccaaauauaguaggauaugaagaucccagaaaucaccaacuuauccaagcaaucagccaaagauuaacagaacacggagaugacggaaagaaggcuuucaaagaacccuuauacaaaccaggaaauaauaaaaguacagcaccaguaguacgaucaguaaaacucuuuacagugcagaaaaguggaaucccaguaagaggaggaauagcgaauaacggaaacaugguucgugucgauauuuucacaaagaaagaaagauacuuugcugucccaguauacguauccgacgcagccagaaacgaauuaccaaacaaagccgucgccagaggcaaagauggauggauagacaucgaugacagcuuuucauuccuauucucauuauacccaaaugauuggguaucagucguaguaaaaccacaugaagcacccugcgaaggauacuaugccggacuagacauaucaacuggagcuauccauauaugggcgcacgaccgaaaccgaagcguagguaaaaauggacucaugcgaagcauaggaauaaaaacagcucacuccguagaaaaauaccacgucgaucuccuuggaaacuuauacagggugguacacgaaacuagaaaaccccuaagagccggaaaauga

SEQ ID NO: 4999 - RNA, 3207 nt, Artificial Sequence
  Cas9 variant
augcaauacguauuaggacuagauaucggaauagccucuuguggaugggccguaauaaaccaagaaaaagaacgaaucgaagacuuaggaguaagaauauucgauaaagcagagaauccgaaagauggcaaaucuauggcaaccccacgacgcgacgcaagauccacacgaagaacauuaagaagaaaaaaacauagaaugcaaaggauaaaaauaaucuuagucaaacaaggcuuacuaucuaaaacagaacuugaccaucuauaugaaucugccacugaaguagacguauggaaucuaagauuagaugcucuugaaagaaaauuaaacccaaaagaauuuacgcgcguauuaauacaccuugcaaagagaagaggauuuaaaagcaauagaaaggaaacuacauuaucagaaaauggccaaaucuuagaaagcauaagcgaaaaccaacagauuaugggacagaaaaacuaucgcaccguaggagaaaugauauuacaagauaaaaaauucgaaagccauaaaagaaauaaagacggaacauacauaggaacaguaacaagacagcaauuacaagaugaaauacagaugauauucaacgcccaaagacucuacaagaacaauuacgccacagccgaauucgaaaacucauauuuggaaauaugggccagucaaagaccauacgcaaguaaagaccaaauagaaaaaaugauuggguacugcacauuagaacaaaaagagaaacgagcacccaaggcgagcuggaguuuccaguauuucguagcuuuacaaacaauuaacaaucuaagacuaauaaguaaagaccguauagaagaacuuucauucgaggaaaaaaaacaaauaaugaacuuagcuuuagaaaagucuaucguaaaauauauagacauaaggaaauuauuaucggucccaaacgaauuucaguucaacucuuuaucuuauucggccgacacaguagacauaacagucgaaaguagaaaauguauugaacuaaaggaauaccacaguauaaacaaaguauacaagcaaaucuaugaaaaaaacgcgcuaaauuugcuuccgaaagacuaugauacaauagcuuacggacuaaccauauuuaaagaugacaaagacauacucgaauacuugcaaaacaaauauguaaaugcuaaagggaaaccaaucucaaacuucgcaaacaagacauacgaugauacguuuauacaagcauuauuaaaccuaaauuucacaaaaaugggucacuuaagcuucaaagcacucaaaaauauaauaccauuuuuagaagaaggcuuaagcuaugacaaagcaugugagaaagcaggauacaacuucaaaggcacaucuuacacagaaaaaacaaaauaucuaccaguuauaccccaaaacaccaaccccgucguacaucgagcccuaagccagacaagaaaaguaaucaaugcuauaauaaaaaaauauggaagucccaacgcaauacacauagaaaccgcacgcgaauugaguaagacauuccaagaacgaaaagaaauagacucaauguaucaagacaauagcaaaaaaaaugaacacgcaauauguaaacuaaaagaacuuggaaacauaaauccuucaggaauaaauauagucaaauuuaaacuuuggaacgaacaagauggucgcugcauguacucaggaaaauacauagaaccacacagauuauucgaagaagguuacaccgaaguagaccacauauuaccuuacucgcgcucauuagacgauucuuacaauaauaaaacacuuacccucggaacagaaaaucaaagaaaagguaacaaaaccccauacgaauacaugggaaauaccucaauauggaacgauuucgaaacgaggguccaaucaaauaaaaaaauaaccaaaaaaaagcaacaaaaacuacuauuacaacauuuuuccuacgccagagaacaagaguuuaucgaacgaaacuugaaugacacaagauacgcaaccaucuaucucucgucauuaauccagcaacacuuaaucuucagugaaucuucaagaaagaaaaaaguacauacaguuucgggaauuauuaccagccacuugcgaaguagauggggcuuuaacaaagacagaaaagaaggccacauucaucacgcacuagaugcaguaauaguagcuguaacaucagaccauaugauacaacgaguaacaaaauauuauaaacuaaaagagcucaaucgaaaucuucaggcaaaacgcaugccguuucccgaaccaugggaaggauuccgccuagaacuugaagcuagaauauccccaaacacacaacaauaccuaaagggguucagauuuaaaaacuacgcagacguaaaucuaagcgaaauuaaaccaaucuucguuucaagaaugcccaaaagaagcauaacaggggaauuacaccaagaaacgauaagaaaauuuauaggauauaacgaaaagggaaaaguacuaacggcuaucaaaacuaaacucgaagauauaccauucgacgcaaacggagacuuucccauguacggcaaggaaacagaucuguauacauacaacgcaauaaaagaacgcuuucucucucacaaaaaggauaaaagaaaaucuuuucaggaaccccucuauaaaccaaccaagagcggaggcauaggaccauuaauaaaaagcaucaaaauuauugacacaagaacaauagucaacccuguaaaccaaggcaaaggggucguauauaauuccaaaauagcccgcaccgacguauucaaaaaagaugaaaaauauuaccuaaucccgaucuauaccauagaccuuaugaaaaauauccuuccacaaaaagcuauaacagcugguaaagguuaugaagauuggacaaccauagacccaucauucaccuuucuauucaguuuauuuccaaaugaucuuauacaaauaguccccagcaaaaacaagacgauaaaagcacgaacuacaguuucaaaaaaagaaguacuacucccaucccuaacaggauacuucaaagguguacauucaggaaccgcaggaauaaccguagagacacacgacgggagcguaaucgccaacguugggucaaaacaauuacuauuguucgaaaaauaccaaguugacguccuaggacacuacacaaaaauaaaggaagaaaaacgaauaggaauggcaauauga

SEQ ID NO: 5000 - RNA, 3210 nt, Artificial Sequence
  Cas9 variant
augaagaaacaaccgcaaagauauaucuuaggacuggaucuaggaaucgcaaguguuggaugggcucucauauuaguggacggagcagaaaacccagugggguuauuagauuguggcgugagaacauucgaacgugcugaaguaccaaaaacaggcgacucccuagcccuagcacgaagacaggcaagaagcguaagacgauuaauacgaagacgagcacaucggcuauugagacucagaagacuauuaaaaagagaaggaauacuaucagcagcagacuucaauucagauggacuaccuaaucugccaauugacgcauggcaacuaagaguagccggccuagaaagaaaauuaacaaaccaagaaugggccgcuguacuacuccaccuagucaaacacagaggauauuuaucucaaagaaaaucagaaacucaaacugaaaauaaagaacuaggaagauuacuagcaggaguagcugaaaauucuaagcuacuuucagaaagcucugaacaauaccgcacaccagcugaauuggcuguaaaauuauuugcagaacaaucaggcagauuacgaaacaagggaggcgauuauacacauacauuuaacagauuagaucuacagaaagaauugcaccuauuauuugaaagacaaugugcauuagguaacccauucgcauccgcagaauuacaaaguaaaguagaugaacuacuaaugacacagcguagugccuuacaaggagaagcaguauuaaaaaugcuaggaaaaugcacauucgaacccucagaauacaaagcagccaaaaauacuuauucagcagaacgauuuauauggcuuacgaaacuaaauaaucuacggauauuauacaauggagaagacagagcacuugaugaaggagagcgcaaacaauuauuagaugaacccuacaagaaagcgaaacuuacauacaagcaaguaagguccauauuaaaccugccggaaagugcaguauuuaaaggcuuacgauauggaaaagauucugacgguuuaaaagcugaaaauggagcauuaauggaaaugaaagcauaucauaaaauaagaacaguguuagaaaaagcagguuuaaaaggagaaugggaaaauagaauuagaaacccagaaauccucgaucaaauuggaacugccuuuucagucuacaaaacagacgaagacauaaaagccgaauuagcagcucuuaggcugccugaaaauguacucgaugcgcuccuagcuggucuaaacuuugauaaauuuauacaacuaagucuaaaagcauuaucaaauauauuaccuuuaauggaaagagguauaagauaugaugaagcguguaaggaaguguacggagaucaucgggcauuagccgaaucaaagaaccaaaugcuauuaccgcaaauacccgcaaacgaaauuagaaauccagugguauuaagaacgcugacacaggccagaaaagugaucaaugcuaucauaagaagauacgguaguccccaaagaguacauaucgaaacagcccgagaauuaggaaaaucauuuaaagauagaaaagaaauagagaaaaggcaggaagaaaacagaaaagaacgagaaagagcagccgaacauuucaaagaacuauuccccagauuuacaggcgaaccaaagucuggagauauacuuaaacugagacuguaucaacaacaacaaggcaaaugucuguacucaggaauaccuauagacuuaggaagguuaaacgaaaagggauacguagaaaucgaccaugcacuacccuuuaguagaacaugggacgauucauuuaacaauaagguucuaguauuaggaucagaaaaccagaaaaagaggaaucaaacacccuaugaauaucuagauggagcacgggauucccaaagauggagagaauuucaagcuaggguacaaggauguagguuuccauacgcaaagaaacaacgaauacaaaccgcaaaacuagauagcaaaacagaacaaggauuuuuagaacgaaaccuuaaugauacaagguacauagcgagauuccuaugcggauucauugaaaagagcuuacaccuacaaggugccggaaaaaggagaguauuugcaucaaacggacaaauaaccgcucuacucagagguuuauggggcuuaaagaaaguucgagaagacaaugauagacaucacgcacuugaugcaauaguaguagccugcaguacagugaguaugcagcagaaaauuacgaaagcuaugcaaaggagggagacccuagagacaaucaacacagaaacaggagaaguuaaaacacgaauaccucaaccuugggauuucuucagacaagaaguaaugauuagaguauucagcgaugcuccacgagaagaacuagcagagaaacucaacucuagacccgaagcacuacaugauuuuguuagcccccuauuugucagcagagcaccaaacaggaaaaugacaggacaaggucacuuagaaacagugaaaucagccaaaagacuuagugaaaauauaucagucguaaagaaaccacugacagcucucaaauuaaaagacauagaaaauauaguaggauacccagaucgagaaccugcauuauauagagcauuacaagaaagauuacaagccuauaaagacgauccagcaaaggcauuugcagaaccguucuauaaaccagcaaaagacggcgggcagggcucacucguaaaggcagucagaauaauagaaaacacaaaacauggccuuaaagugagaaacgggauuaccgacaccaacggagacaugguacgugcagauguauaccagaaagccgacaagaaagggaaaagacaauauuuuauagucccaguuuacgcauggcagguagagaaaaacgaacucccaacaguagacuguaaaggcuacgaaaucgaugacacuuacgaauuuuguuucucuuuauauaaauaugacauuauagaaauccaaaaucccgacaauaugucaaaagaauuaagggucuauuacauuaacugugacaguagugacggccgauucugguuagcacaccacgauaaaagugcaaaagaacaacaauucagaauaagcacucaaaaccaaccuauaauaaagaaauaucaaguggaucccuuaggaaaagaaauaagauuauguaaagccgagaaaagaacagaacuaaacggaaagaagaagaaauga

SEQ ID NO: 5001 - RNA, 3210 nt, Artificial Sequence
  Cas9 variant
augaacuacgauauuggacuacgcaucggaauuacaucuuguggauggagcauaauaaauaaagauuuagaaagaauugaagacuuaggaguaagagucuucgaaaaagccgaaaaccccgauggaacagccucagcugcaccaagaagagaagcuagaaaaucucgaagaaaacauagacgaaaaaaacauagaauagaaagaauuaaaagacuaauagugcaacaugaccuacuaucuaaaaaagaauuggauucauuauacuuaagcccauuuaacauagauguauggaaucucagaguugaggcacuagaaagaaaauuagacaacagagaauucgcacgcguacuaauacauuuaguacaaagaagaggauuccaaacuauaagaaaaucagucgaaauucaagaagaaggaaaacuacuugaaaauguaagcgaaaaugaacgaauuaugaaagugaauggauauaaaacaguaggcgaaauguuuagcaaacacgaaaaauuuacacaccauaaaaggaauaaagacggaucauacacaaguguagucacuagaucccuacuacuaaaagagauaaagacaauuuucaacucacaacgcauauuagguaacguauuuucgacccaaaaauuagaaucagacuacuuauauauauggggaucgcaacguccaaccuuaacauacgaacaauuaauguccauggucggaaauuguaucuacgaaaaaaaagaaaaaagagcaccaaaaacaaguugggcuuuucaauauuucucauuauuacaaaaaauaaacaaauugaaaguauccgacgacaacacacuaagaaaauuaucaaaagaagaaagagacauaguaauugaauuagccuucaaaaaaaagaacguaagcuucguagacauaagaaaggcucugaaauuaaacgacaauacgaaauucaaccaucuaacauacucucauguaguugaaacuaaaaaaguugaaaaagcaacauuuauagaauuaaaaggauaccaucugauaaaaaaacaauuaaaagacagaaacguagaacuaacccaagaacuacaaccaaaagacuacgacgccauagccgcagcaucgacauucuucaaaaaugacauagaauucagggacuaccuaagaaaucaauaucuggauucaaauggaaaacguaaaaguaauauagccaacaaaguauucgaagauaaaguuauagcggcaguauuugaauuaaacuucuccaaggugugccaccuaucauuuaaaucacuauacaagcugaucccacaucuagaaaaaggauuggacuacaaagaggcaauuuugugcgccggcuauaauuucagagaugaaaauaaacgagauaaaaagcuauuccuaccgguaauccaacaagaaaccaacccaguagugcauagagcacucacacaagcccgcaaaguaauaaacgcaauaauaagagaauauggcagucccaauacuaucagauucgucguugcaaacgaucuagccaaaacauacaaacagcgaaaagagcucgaaucuacuuuaaaaaaaaauagagcagaaaaugaaaaaaucaaaacaaaacuguuauccaugggaaucauaaauccuacaggcauggacaucguaaaauacaaacucugguaugagcaaagcggaauaugcuuguacaccggaagacaaauggaacucagcucucuuuucaaaccaggauauucaauaguaaaccacauaauuccuuauaacagaucauuugaugacaccuaccacaacagaguucucacacuaacagaaacaaaauacgaaaaagguaacaagauacccuucgaauacuucggagcagaagaaacuuguuggaaugaauaugaaaaaaggguaucuacaucaaaaaaaauacacgauaaaaaaagagaaaagcuuuuaauacggaacuuugacaucgaauacgagaaugaaaugauauccaauaauguauucgacacucacuacauagguucauacuuugaaaaauacauugacgaacaccuacaauucaaaaaaagcacaaaaaaacaaaaaguguucaguauacacgguaacaugguagcacaccuccauucucgaugggguuuuaauaaaaauagucgugaaauauauuuaaaucacgcaguagacgccgcaauaguagcuguacuuacagaucaacuuauaaggaacauugccgauuacuacagacgcgauaauauacuagaacaaaaaggaagccuaaaauuuccagaaccauggaaaucauuuagcauagagcuggaagcaagaauuuccccucaaguaagagaucucauaaaaaaacuaaauuuagauuccuauuuagacgucgauauacugcacauaaagccaguauuuaucagcaaaaaaccucguagaaagguaaauggagaagcccacaaaagcaccauacguagucuaaucggaauaaaugaaauaggaaaaacaguuacaugcauaaaaacuagacuagaagauauacccuucgacgaaaacggugauuuuccaauguauggcaaagauacagacaaauacacauauacagcgaucaaagaacgcuacuuagaguuuaacaaagacaaagaaaaagcauuuuccaccccauuauacaaacuuaagagaaauggagaaccgggaaaccaaaucaaaucaguaaaaauuauagacacaagaaacauagucaauaaaguaaaucaaggcaaaggaauagccuacaacucaaauaucauuagaguagacguauucucacgagaucaaaaauauuacguagugccaauauauuugcgagacuucauaaaagguuccuuaccgaacaaaauuaucacugccgcgaaaggauuuaugcaauggcccgaaacagacaacaguuacacauuccuguucaguaucuuccccaacgaucucauaaaaguaguaccuaaagaagggaaauucauuaaagccaaaaacgagaauaaagaaaacauuaaccuuacggaaauacucggcuauuucaaaggauuagacucaucaacaggagcauucacacuggaaucacaugacgguagcuuacuagcaagaggaauuggaaccaaaaacuuacuauuaauagaaaaauaccaggucgauguucuaggcagauacaauaaagucggcaaugaagaaagacaagauauaaaaauacaacaaaacuga

SEQ ID NO: 5002 - RNA, 3210 nt, Artificial Sequence
  Cas9 variant
augaacuacgauauuggauuaagaauaggaauaacaaguuguggauggagcaucauaaauaaagaccucgaacgaauugaagacuuaggaguaagaguauuugaaaaggcagaaaauccagacggaacagcaucugcagcaccuagaagagaagcaaggaaaagcagacgaaaacacagaagaaaaaaacaucgcauugaacggauaaaacgauuaauaguacaacacgacuuacuuucaaaaaaagaguuagacucauuauaucuaagcccauucaauauugacgucuggaacuuacaaguugaagcgcuugaaagaaaacuugacaaccgugaauucgcuagaguacuuauacaucuaguccaacgcagaggauuucaaacaauacgaaaaucuguagaaauacaagaagagggaaaauuauuagaaaacguaagugaaaacgaaagaauaaugaaaguaaacggauauaaaaccgucggugaaauguuuuccaagcacgagaaauucacacaccauaaacgaaauaaagauggaagcuauacaagcguuguaacgcgaucacuacuacucaaagaaauuaagaccauuuucaacucacaaagaauacucggaaacguauuuucgacacaaaaacucgaauccgauuaucuauacauauggggaagucaacgccccacuuuaaccuaugaacaauuaaugucaaugguuggcaacugcaucuacgaaaaaaaagaaaaacgggccccaaaaacaucaugggcauuucaauauuucucacuucuacaaaagauaaacaaacuaaagguaagcgacgacaacacacuaagaaaacuaagcaaagaagaaagagacauagucaucgaacuagcauuuaaaaaaaaaaauguauccuucguagauauucgaaaagcacuaaaauuaaacgauaacacaaaauuuaaucaccuaacuuacagucaugugguagaaaccaaaaaagucgaaaaagcaacauucauagaacuaaaaggauaucaucucauaaaaaaacaacucaaagaucgaaacgucgaauuaacacaagaauuacaaccuaaagauuaugaugcaaucgcggcagcuucaacauucuuuaaaaacgacauugaauuucgcgauuaucuucgcaaucaauaucucgacucaaaugguaaacgaaaaucaaauauagccaauaaaguuuucgaagauaaaguaauagcagcaguauucgaacuuaacuucaguaagguaugucacuuaucauuuaaaagccuauauaagcuaauaccccaucucgaaaaaggacucgauuacaaagaagcaauauuaugugcuggcuacaacuucagagaugaaaauaaaagagacaagaaacuuuuccuccccgucauacaacaagaaacaaauccaguuguacauagagcauuaacccaagcaagaaaaguaauaaacgcgauuauaagagaauacggaagcccgaauacgauaagguucguaguagcaaacgacuuagcuaaaacguauaaacaacgaaaagaauuagaaagcacccuaaaaaaaaacagagcagagaacgaaaaaauaaaaacaaagcugcuaucaaugggaauaauaaauccuacagguauggacauaguaaaauauaaacuaugguacgaacaaucaggaauaugcuuauacacugggaggcaaauggaauuaucaucacuauucaaaccuggauacucaauagucaaccacaucauaccuuauaaccggucauucgacgauacauaucacaauaggguacuaacauuaacagagacuaaauaugaaaaaggcaacaaaauacccuucgaauacuuuggcgcugaagaaacaugcuggaacgaauacgaaaaaagaguauccacuucaaaaaaaauacaugauaaaaaaagagaaaaauuauuaauacgcaauuucgauauugaauaugaaaacgaaaugaucaguaauaauguuuucgauacucacuacauaggaagcuacuuugaaaaauauauagaugagcacuugcaauuuaaaaaaucaaccaaaaaacaaaagguauucuccauccacgguaacauggucgcccaucuacauucgcgauggggauucaacaaaaauucgcgagaaaucuaccuuaaucaugccguugaugccgcaaucguagcaguauuaacugaucagcuaauaagaaacauugccgauuauuacagacgagauaacauucuugaacaaaaagguucacuaaaauucccagaaccuuggaaauccuucucaaucgaauuagaagccagaauaagcccacaaguccgagaucucauaaaaaagcugaaccuagacucauauuuagauguagauauacuacacauaaaaccgguauucauaucuaaaaaacccagaagaaaaguaaacggggaagcacacaaaucaacgauaagaagcuuaauagggauaaacgaaauaggcaaaacuguaacuugcauaaaaacaagacuagaagacauaccguuugaugaaaauggugacuuucccauguacggaaaagacaccgauaaguauaccuacacugccaucaaagaaagauaucuagaauuuaauaaagauaaagaaaaagcuuucaguacaccucuuuauaaauuaaaaaggaacggagaacccgggaaccaaauaaaaagcguaaaaauaauagauaccaggaacauaguaaauaaaguaaaccaaggcaaaggaauugcauacaauaguaacaucauacgaguagacguauucucuagagaucaaaaauacuacguaguaccaauauacuuacgcgacuuuauuaaagggucacuacccaauaaaauuauaaccgcggcaaaaggauucaugcaauggccagaaacagacaacucuuauacguucuuauuuucuauuuuuccuaaugaccuaauaaaagucguacccaaagaagguaaauuuauaaaagcuaaaaaugaaaacaaagaaaacauaaaccucacagaaauccuuggguacuucaaagggcucgacaguucuacaggagcuuucacacuagaaagccacgacggaagccuauuagcuagagggauaggcaccaaaaaccuuuugcuuauagaaaaauaccaaguagauguacuaggccgauacaauaaaguaggaaacgaagaacgccaagacauaaagauacaacaaaacuga

SEQ ID NO: 5003 - RNA, 3213 nt, Artificial Sequence
  Cas9 variant
auggcuaccagauuaggacuagacauaggaacaaauaguauaggcugguguuuauaugauggugacuccauacgcgacauaggaguaagaauuuuucuagauggacgggagccuucaaaacuuacaguuagugggagugguacacccuuggcagucaaaaggagagacgcgagaggagcacgccgaagaagagacagguauauaggaagacgauccgcaaugcuaagagaacucagaaaacacggcuuguuaccagccgauccaaaacaggccaaaguacuagaaacacaagacccuuaugcacuacgaguuagagcgcuugaugagaaauuagaaccacaccaaauaggaagggccuuauuccaucugaaucaaagaagaggcuucaagucaaauagaaaagcagaaagagcguccaaagccggugaagaugguaaaauagcaacagcgacaaaauuguuagaugaagaaaugcaaagauuaggagccagaacacuuggagaauuucucguaaaacgagauagugaauuugacggagaagcaggaaaacguguaagaaugagagcagacucgaaggcuuaugauuuuuauccugauagacgacauguucuagaugaauuuagagcaauauggaaugcacaaaaagucuggcaucccgaauuauugacagaacaagcauggaaugacaucuuucguguaauagaauaucagagagaauuaaaaccacaaguaguggggcauuguacauuugcuggaauaaacgguguaccagcagacgaaaaacgacuuccuaaagcacauccccuauuccaacagaggagacucuaugaagaaguuaaucaauuaaaaguuguagcgcccggagaagcugggcguccucuaacuagagacgaacgagaugcccuaauacuuaaauuacaagauaagaaaaguguuagcuuugagacacuuggaaaaacucuaaaauuaaaagauggugaacgauuuaacaaagaaagcgagaauagaaaagcacuagacggagaugaaguaagagcggcgcuaucaggaaagaaauuauucggaacaagaugguuccauuucucugcagaggaacaauggaugauaauagagaggcuccuagaagaagaagacucagaaacauuauuaacaugguuaaaaauagguuauagauuagaugaugaagcagcguuagcuguggcaaaugcaaaauuaccagaagggcauggaagauuuggauuaucagcuacaaccgcucuacuuaaagaauugaaagcagauguguguacauaugcagaagcugcuaaaagagcaggauuucaucacagugacuucagaacaggagaaguauuugaucaauuaccauacuacggagaaauacuagcuagagaaauagcaccuggaaaaccagaauacggagaugaaaacgagcgaagauucggcaaaauaacaaacccuacaguucacauaggacuuaaccaauuaacuaagcuaguaaaugcuauaauuagacuacauggaaaaccagacuauauuuuuguugaauuggcaagagaauuaaaauugaacgaaaaggagaaaauagcauauaauaggcaacuuaaagaaaauacagaugcugcucgagauaggggagcgaagcuagguacaaugggaguuagagacacggguagaaauagacucauucuuagguuguggacagaauuaaauccaggugaugcauuaaacagaagauguccauucuguggagaacaaauaucacaacgaaugauucagaauggagaaguggaaauagaacacauaauacccuauagccaaugcuuugaugacggaauagguaacaaaguacucucacauguacgcuguaaucgccaaaaaggagaccaaacuccuugggaacgguggggacacgacccagauagauggaguauaauacaggaacaaguugcacaucuacauaggagcaaacaauggcgauucggcccagaugcaagagauagauaugccgcagaagaagauucauuccuaccgagacaacucauagacacacaauauuuaaccagaauagcugcuaaguauuuagccugucuuuauccggaacgcggcgaaagacacguauuugcaguacacggcgguaugacagcaaugcuacguagacuaugggaucuuaauucaauacuacuagaccauaauuggguagaaaaccugaacuccaacgcacccaaaaacagacuagaucaucgacaucaugcaaucgaugcugcuguuguagguauaaugacgccuggacuaauugcugaaauugcaaaagcagccgcccgagcugaaaagcagaacuuagaucgacuauuugaagaacuaccuaugccuugggcacaacacccaaacgacagaagauucagagaugaacuaagagagaaaauauuagcagcuacagugagccacaaagccgaccauggcagacaagguaaaccggaaagaggcagagauaucacagcaggcaaauuacacaacgauacugcuuacggguucacuggcuuaacgucagacacuggacuuccaguuguaguacaccgaguuccauuaacaucccuuacaccaaaagauauagcagacccagauaggauaccggauacuacuuugcgaggaucauuauggcaagccacacgagaccuaucaggaaaggaauuugaaaaagcauuacuugauuuuaguagaacucaugcacaguucaaagguauacguagagugcgaguuagagaaggcuuaacauuaauaccaauaagaaaccacgcaggaaaaccguacaaaggauaucucggugauuccaaugcgcgauauaauguauggcaaaugccugacggaagaugggugcaucaagugauaucaacuuuugauuuacaucaaccaggauuuauagaacaaaggccccacccagccgcuaagaaagugcuuaguuuaagacaaaaugacuuaauagcuauagaaagagauggagcauuacgacagauaaugagaguacaaaaauauggucaaaauggacaaauauuucugauagaacacaaugaagcaggaaauauggcagaaaggaacaaaaauacagacgauccuuuuaaauuuuacggccccggggcaucagcauuaagaaauaugaaagcccgacaaguaaggaucgaugaacuugggcgaauauucgacccaggucccagauga

SEQ ID NO: 5004 - RNA, 3213 nt, Artificial Sequence
  Cas9 variant
auggcaaaagauuuugaauauauauuaggacuagaucucggagaaacaaguauagguuggucagucguacgacuaaaugaaggagucccagaacaucucgagagacuaggcguacguauauguagcgauggaagggacgcgcagucccacgagccacugucaguugcaagacgaauagccaggggccuaagaagacgacgggauagguauauacauaggagaauaagauuaacugacguacuuguuaaauauggacuaaugccggaagacauaaaagaaagaaagaaacuacaagcccuaaacccauaucgcuuaaggucugaagcucucgauagaaaacuagaacccuaugaauuagguagaguguuauuccauauaaaccaaagaagagguuuuaagaguaauaugaagacagauagaaaagauucagaaaguggagcuaugaaacaagcaauacuuaaaacaagagcgaagauggaagcgagcggcgcccguacucuaggagaguuuuuauacuuuuuaaacaaagacaaaacaucaacacaagaauacguaccuguaagaaugagaagucacagugaaaagaauaagacgguauacgaaauguauccugauagagcgauguaugaagacgaaguccauaaaaucuucgaacaacaagaacuaucaccagaagcccaaacagaaauauuuaauacgauauucuuucagagaccauugaaaccaguugaacuuggauuuugugaauuugaagauggagaaagacgagcauauacagcaucaguaguuuuucaaaaauuuagagcacuucaacaaauaaaucaaauauauguacaagacgauuacgagagaagaccauuaacuaaagaagaaaaagauauacuaaaacacuuuuuauuagaagauuuuucagcauuggauaaaaauggacuacucacaugggcuaaagugcgaacucuccuaaaacuacagaaaaagaaauucaauuuagaaucagaaagaagaaaaggauugaacgcggacguaacaaguuggaaauuaucaaacgcagcauguuuuggaagggaaugguucagcuuuucagacgcgaagaaagaagaaauaguagcacugaucacaggagcagaaaaagaagaagaacuuauagcagaauuaaaaacaaaauacggauuaagcgaugaaagggcuaaaaauacagcaaauguaaguuuaccagauggaguugcaaguuuaagugcaaaagcaaugaagaaacuuauaccuuucuuagaagaaggaauguuauaugacgacgcagugaaacaggcaggauauguuuuuaguagcagcuuuaaagguguacuacccgaaaaauacgaaacauuuauugaaccagaaucaggggaauguuucgacgaauugccauauuacggacaaguucuaagaagauauguauuaggagggguuccguccgaagaaaacaaacuauuuccagaaaaauauuauggaaaaauaaacaacccaacaguucauauuguucuaaaucaauuacgcaaauuaauaaacagcuuaguagcuaaauacggacauccuagaaagauaguuguagaaauggcacgagauuuaaaacuaagcaagaaacaaaaagacgcuauagcaaaagaacaagcucuuaaugaacgagaaaauaaaaggauaggagcggaacuagagagacuagauauuagaaauaauuacgauaauagaaugaaauauaaguuaugggaagaccuuucaacugaucccacaaaaagaucaugucccuuuugcggcaaacaaauaagccaacaagauauauuuaguccugaguuugaaauagagcaucuaaucccauuuucgagaucauuuauggacgguagaagcaauaaaguuuuaucauguaggagauguaacagagaaaaaggaaacaaaacaccauucgaggccuuuggaaacgacucgacacgguggaacgccaucauggguagaguagaaucguuaccagaaaauaaacgcuggaaauuugcaagugaugcaaugaguagauuugaaagagauggcgaucuacuagcuaggaugaugacagauacgcaauauauggcuagaauagcaagaagauaucuauguugugcagcaaauccaaaucaaguguacggaauaccaggccaacucacagcaaaguugagagaacauuggggauuaaauucaauauugagugaucaaaaggaaaaggaccguagcgaccaucgucaccacgcgauagacgccuucguaguggcauguacggaccgaggaacauugcaaaaguauucaacggaaaggagagauuacgcaaaaccagagaugccaucagaaaaagcaccccacauaccauuugcagauuuuagacuuagcgauauaaaaagaguguuugaugagauaauagucagccauaaacccgauaggggaaaugccagagcagcaauccuaaaaggggguacagucgcaaaauuacaugaggagacauauuacggaaugggaggagaagguaguaagaaaggaacuuggaaauuaauacaaaggauuccaguaagcgaaauaaagaaagcgagugaucuugauugucugauagaccaaaaagguacagcgaauccucuaagaguauuauuaguaggugcaagugaaagugaacaagaacaaauaauagcuagcuacuuugccagaagggggacacauaaaguaaggacauauagagagaggaauaaggauguuauuuuaccauucaaagauaaagauggaaaacuauaucgauacgcugucuaugguucaaaugccuaugcugaaauuuauugcccagaucgagguaaaaaugcaggaaaauggcaaguagaaauuauuccaaauuacugugcacaccaaaaaggauuuauuccaaaauggcgucacacagacgcgcaugcaaaauuaauaaugagauuauacagaaaugacauggucgcauaugaaaaagaaggaaagacuguuaucgcccgaguaaagaaaauggguggaaauggaguaauuguguuuagaaaucauuuaauagcuaaagaggagggagacagacugucauggcaagcaguaguaucagggaugcaaagcgcaaaccuaagaaaaauauauguagauguccugggccgaguaauugacccaaaaaggccgaugacucaaaaugaaacagacggacaggacaauuga

SEQ ID NO: 5005 - RNA, 3213 nt, Artificial Sequence
  Cas9 variant
augucacacuuuagauuaaaacaauuaaauuauauacugggacuugaccuaggaauagcaucuguugguugggcuguuguggaaaucgauacagaagaaaacccaacucgacuaauagauguaggaguaaggacauucgaacgcgcagaaguaccuaaaacuggcgauucacuugcagcagcuagaaggcaagcucgaucagcaagacgacuuauaagaagaagaacccauagguuacuaagggcaagaagacugcuaaaaagagaagguauauuacacgcugacgaucuaaaugcugaaggccuaguuaaagaacuuccaaacacaccauggcaauuacgaguugacggccuugauagaaaacuaaugccaaaagaaugggcagccguucuucuucacuuaguaaaacaucgaggcuauuugucacaaaggaaaaaugaaagcgaaggagccgauaaagaauuaggaagacuauuagcugguguucaugaaaaccaccaagcacuacaaucaucagaauauagaaccccugcagaacuagcaguuaagaaauuucaagcacaaagcggucacauuagaaaucagagaggagacuauacacauacauuugacagaaaggauuuacaacaagaauuacaucaacuauuugcagcacaacaaaaauauggaaaucccuuugucagugauggauuaaaacaaggcaucgaaacauugcuaaugcaacaaagaccagcccuaaguggugacgcaguacagaaaauguuaggucgaugcacauucgaaacugaagaguucaaagcagccaaacacacguauucggccgaaagauuuauauggcuaacuaaacuaaacaaucugagaauacaagaaaacgggaaugagaggugcuuaaccgcccaagaacguggccaaaucauugacuuaccguacaagaaagcaaaacuuacauaugcacaagugagaaaagaacuaucuuuaccagaaaacgccuucuuuaaaggucuacgcuauggcaaagaaaaugcggaaacagcugcuuugauggaaaugaaagcguaucacgccauuaggaaagcauuagagaaagcuggauuaaaaacggaauggcaaggacuagccugcaaaccagaacuucuagaugcaauagguacagucuuuucucucuauaaaacugaugaagauauaagcacaagauuacaaggacaacuaucagaagauguuauuaaugcacuucucgccggauuaaacuuugauaaauucauacaacuuucuuuaaaagccuugucaaaaauacuuccauuaauggaacaaggacaaagguacgacgaagcccacgcagcccuuuacguaagaucaacaccucaaccucaacgccucuuaccacagauaacggcagaugaaauaugcaauccgguaguacuaagaacgcuaucacaagcuagaaaaguaauaaaugcuaucguuagacgauauggaucaccagcaagaauccauauagaaacuggccgagaagugggaaaaaguuuuaaagauaggcaagagauacagaaaagacaagaggauaaccacaaagaacgaaaacaagcagcagaaaaauucuuagaauauuucccuaauuuuguaggucaaccaaaagccaaagacauauuaaaacugagauuauaccaacaucaacacggacaaugucuauauagcgggaaaacccucgauauaugccgacuuaaugagaaagguuacgccgaaauagaccaugcacucccauuuaguagaacuugggaugauaguuucaauaauaaaguguuaguuuuagcuggcgagaaccaaaacaaagggaaucagaccccauaugagugguuaggcggggcaucaaacucaccaagguggcaagaguucguagccagaguuggcagcagcagauuccaccacagcaagaaacaaagaauauuauuaagacaacucgacgaagaaggcuucaaagaacgaaaccuuaacgacaccagguacguagcucgguuuuuauguaaauucaucgaagaaaacaugcucuuacuaggacgcggaaaacgacgcguauucgcaucaaauggacaaauaacauccuuucuuagaucaagauggggucucagaaaagucagagaagaaaaugacagacaucaugcauuggacgcaguaguaguagcaugcucaacaguagcuauccaacaaagaauuacguacuucguuagacagagagaaaugaauauauuugauggagaauuaauagauaaagaaacauccgaagucaguagaccauacuucccucaaccaugggacuucuuuagacaagaaguaaugaugagaguauucggcaaaccagauggagauccaucauucccggaagcagauaccaaagaaacauuauguacacuacuagaaacgagauuaucuucaagaccccaagcaguacaugaauaugugacaccccuuuucguaagcagggcgccuacccgaaaaaugagcgggcaaggacauaaggaaacuguaaaaucugcaaaguuauuacacgaaggaaaaucaguacuacguguaccauuaacacaauuaaaaccaaauuugcuagagaaaaugguuaaucgagacagggaaccgcaauuauaugaagcccuuaaagaaagacuagcagcauaugguaaugauccagccaaagcauuugcgacugaauuuagaaagaaagguggacaauuaguaaaggcgguucgaguagaagauacucagaaaagcggaguauuacuacauaaaggaacaggaguagcagauaaugcgacaaugguuagaguagauguuuucgaaaaauccggaaaauauuaucucguaccuauauacucauggcaaguugcucaagguauacucccuaauaaagcaguaauacaaggcaaagaugagaaaaacugggaugaaauggaugaaacauauacuuucaaauucucaauguauccgaacgaucucguagaaaucaauaccggaaaacaaagguuauuuggauauuauauaggacucgauagagcgacuggagcaauaucuauuagggaacacgacuuagacaauuuuaaagguaaaaauggaauuuaccguguaggaguaaaaacggccauaaguuuuaagaaauaccaaacagaugaacuaggaaaaguuguuguuccaugccgaccgaagaaaagacuaccaguuagauga

SEQ ID NO: 5006 - RNA, 3216 nt, Artificial Sequence
  Cas9 variant
augcgacuaggccuagacaucggcacaaauucaauaggauggugguuauaccaaacagacgauggaacaauaacagaugugcuggauggaggagugcgaauauuuagugauggacgugauccccaaagcaaagaaucacuggcuguagauagacgaguagcacgugcucaaagacgucgacgagauagguaucuucguagaaaagcagcgcuuaugaaaagaauggcuggagcaggcuugaugccuacagaucaagcacaugcaaaaaaguuagaaagucucgauccauacgcucuuagagcggaagguuuggauugugaauuaccauuaacacaucucggacgcgcacucuuccaccuaaaucaacgaagaggauuuaaaucaaauagaaaaacggaucgaggggauaaugagucgggaaaaauaaaagaugcuacggcuagauuagacugggcaaugagagaugcaaaagcaagaacuuauggcgaauuccuacacacucgucaacaaaaagcggaugacccuaaaagaaugccaacuguuagaacacgcuugacuguagcgcguagagacaaugcggaaaaagaagaagcagguuacgauuuuuauccagauagaagacauuuaucagaagaauucgaugcauugugggcggcgcaggcagauuaucaugaagcacuaucagacgaccuuagagaucaaaucaaaacuauuauauuucaccagcgaccuuugaagacaccugaaguaggcuuaugccuauuuacagacgaacgaaggauaccuucagcccacccauuaaaccaacgacgaauauuauuagaaacuguuaacgcccuccgaauaguagccagaggcgaagcagcaagaagacuuacauuagaagaaagggaucaaauuguucaugcauuagauaauaaaaaccauacgaaaacuuuaagugguauggccaugaaacuaaaagcguuagguaaaguaauaagauuaaggucggaucaaacguuuacauuagaaaccgccaauagagacgcuauagcaugugauuuaguacgcgccagccuaucacaucccgacagaauggguggaguuuggacuaccuuagaugaaggagcacaaugggaaguaguacaacgaauaagggcagugcaaucagacucagaauucgaugccuugguaguaugguuagaacaaaaucacggucuagauaaugcacaugcacaagcaacagcuaaugcaccacuaccagaaggauauggacgaaugggauugauggcuacaagaagaauacuagccgcccuacaaagcgacguaaugccauauucugaugcaguagcagcaugcgguuggucacauaguggcggaccuaccggcgaaguauuagaaaaauuaccauauuauggcaaaauauuagacaggcauguuauaccaggaacauaugaugaaaauaaugaagacguaaaacgauacggaaggauaacuaacccaacaguccacauaggacucaaucaaauaaggcgucuaguuaauagaauaauaugcauacauggaaaaccagacgaaauuguuguagaauuagcgagagauuuaaaaaauagcgaagaccaaaagagagaaauacaaaaaauaaucaagaagaauacagaugcagcuauaaagagaggagaaaaauuaauaaacgaacuaggucaaaaagauaccggagcaaacagacuaguauuacgauuaugggaagauuuaggacacgacguaaugacaagaaauugcccuuauaguggaaagcgaauaucggcgggcauguuauucgaugguucaugcgaugucgaucauauucuaccauauagccguacuuuagacgacggaauugccaauaaaacacuauguuugaaagaggcaaacagacaaaaaaguaauaacacaccaugggagguauggggagaaacagagcaaugggacacgauagcugcaaacuuaaaaaauuugccagauaauaaagcuuggagguuugcaucugaugcaaugcaaagguuugaaggagaaaaugacuuuagcgccagagcuuuaaaagacacgcaauaccuaaguagaauagcaagagcuuaccuugacgcuuuauaugacggaggagacggcaauucgcacguauggguuguuccgggaaggcuaacugaaaugcuaaggagacauuggggacugaacggccuagaagcauuaacggauagcgaugaaaacacaguuaaagcaaaaaauaggauggaccauagacaucacgcaauagaugcagcaguaguagcggcuacugauagaggauuaauucaaagaauaucaaaaauugcaaagcgggaugaacaagcaggugcugaggaaguagcuagaucaguaagcccaccuugggacgguuuucgagaugauauagcagcacaacuaaguagaauaauaguaagucaucgggcagaccacgggcgaauagacagucaagcaaaacaacaaggugaagaugcaacagcaggacaacuacacauggauaccgccuacggaguaguggacgcgggaagaguaguuaguagaaagccuuuacuaucacugagcgaauccgauauaaagaaaauaagagauccagaucuacaaaggcaccuaacaagaguaacaaaagguuuagauaaaaaagaauuugaacacgcccuaagcgauuuugcaaacgcgagaaaauugccagaccagagcgaaaauccuuacuuuggaaugcgucgaguuagauugaucgaugcauuacaggauucagcacgaguaucaguaagggacagagacggccauauauacaaggcauacaaggcaggcucaaaucauugcuacgagguauggagacuacccgaugggaaaaucaagccaugggcuaucuccacauuugaagcucaccaaacuggaacagaaaguaagccucauccagcggcuaaacgacuauuaagaguuuucaaacgagacauggucgcaauagaacgugacggggaaacuuuaaugugcuauguacaaaaaauggacauugcuaauggacucuuucucgugccacauacagaagguaaugcagaugcaaggaacagagacaaagaugauucauucaaauucauacaaaugagcgcagugagccugauaagagcaaagauaagacgaauacacguggacgaaaugggaagauuaagagaucaaggcccaccacgauga

SEQ ID NO: 5007 - RNA, 3216 nt, Artificial Sequence
  Cas9 variant
augagauacacgauagggcuagacauaggaauugcaagcguaggaugggcagucauaaaugaagauaaaucaagaauugaagaccugggcguaagaguuuucaaaaaggcagaagaaccagacggcaaaagucucaaccuagcuagaagagaagcaagagggagcagaaggagaaucagaagacgagcaacaagaaugcaaaaagucaaagaacuauuagugaaauacaauuuaguaucagaaaaagaacuagaaacacuuuacauaaucacagaaacaacaccagauguauacgaacuaagagcaaaaggacuagacagacuacugagcagacaagaauuugcaagagugcuuacuaacauugccaaaagaagaggguauaaaaguaauagaaaaauugacgaagaagacaaagaaguugguaaauuaucaaaaggaacaaucgaaaacaaaaggaucuuacaagaaaaaggauacagaacaauaggagaaauguuuuacaaagacgaaaaauucgaauacaacaaaagaaauaaagcaggagaauauaacucaaccguacuccgaucaaugcuaauagacgaaguacacacucuauuugaaaugcaaagaaaauucaaaucagaauuugcaaaugaagaauuugaaaaagaguauguagagguaaugacauaccaaaaaccguacauaacacccgaauuacuugagaaaaugcuaggaaaaugcacguucgaaaaaggcgaacccagagcacccaaaaacucauacacauucgaaagauucaugcuacuacaaaaagugaauaauuugaauauauauauaaauggcgaaaaaguugaaauaccacaagaaaagaagaaagaaaucauugaacuggcguauaaacaaucagaaauaaaauauacacaacuaagaaagaaacuagaacugcccauagaggcuagguucgccgauuuaaauuaucaaaucaaaagaacagaggacgaaagugaggaggcuuuaguaaagaaaauugaagacaagaaauuuguaaaacucgaaggcuggcacaaaauaagguuagcauuaaaagaaaacaaagauaaauuugagaaaauugagaaaaauccugagcuacaaaacauaauagcagaugcccugguaagaaauaaaaccgacgaaacaauuaaaaacuaccuagaaaaaucagacauagaugaagaaauaauuaacgcaauacugaacaucaacuucacgaaauuuggccauuuaaguuacaaagccaugaauaaaauaauaccagaauuggaaaaaggcuuaacauacgacaaagccugcgaaaauguaggauacgaauuuaaaggaagaaagaacgaacuacaauauaaacuaccaccgguaacugaauuagaagaugaaauauuaaauagugucguauuaagagcagugagccaaacacgaaaagucauaaaugcgauaauagacaaauacgguagcccaacagccauuuauauagaaacagcaagagaacuaagcaaaccauaugacgaaagaaugaaaauugagaaaagacaaaaagaaaacgcugcaaacaacgaccaaauuaaagaauauaucaaagaaacauucggauuugauccuaaacccuuugacauaguaaaaaugaaauuauggagggaacaaaacgguaaaugcgcuuacucaaguaaaccaauaccagcagagagguuauaugaagaaaacuucguccaaguagaucacauaauaccguuuucucgauguuucgaugauagcuaccaaaacaaaguucuaguauugacugaugaaaaccagaaaaagaaagaaagaacacccuucgaguauuuuggggaagacaaagaacgguggcaccaauucgaagaguucguaaacuuaacauauaaauucaacacaagaaagaaagaaaacuuacuaauuaaaaauuucaaugaagaaaaaucaaaagaauggauacaaaggaacauaaaugacacaaaauacauaucaaaauucauguacaauuacauagccaauaacuuaaaauuugcagauagugaaucaaaaagaaaaguuuauaacauaaacggacaagccacaagcauacuacgacacuacuggggacuaaagaaagauagagaagaaucagacaaacaucaugcacaagaugccgucauuauagcaugcgcaacaaacaaaaacaucaagaaaguguccgacuauucaagacgaaaauuacuguacaaaaacaaugagauaaucgacgaggaaacaggagaaauaaucgacaagaaauacaacauagacauaagcauaaaagaaccauggccuaaauucagagaagaaguagaagcaagaauggaggacgcagauaauaauggacagcucuacgcacugaucaacggaaacuucacaaacuaugacgauguggacauaacacauauaaagccgaucuucacaucgagaaugccugaaagaaaaauaaccggacgugcucacaaagauaccaugcgaucacaaaaauucauacaacagggacaaaacuuuaccguggugaagaaaccacucaaagcaauaucaaaacaagaaaucgaagguauuauaaacaauccagacuuuaaaaaucuauacuuaucagacaagaaauuauacgaugauauauaucagaaaaugaaagaagcagauuuuaaagcagaaaaagcauuugcaaaugaauacagaaaguauagcaagaacgggaacucaccuauuguaagaaguauaaaaguagcuuccgccggugcuacaggagugcaacuaaagaacggagccauugcggaaaacgcaaauauggugagaguagacguuuuugaaaaagauaauaaaaacuauuuaguaccaauauauguuagcgauuuugccaaaaacgaauuacccaacaaagcaaucugcgcaaauaaagaugaaaaagaauggauugaaaugacugaaaaguauaaguuuaaauucagucuauauccaaacgaccugguaaaaauaaagaggaaaaacgaaaaagaguucuaugccuauuacugcucaacccauagaggaacgggaaacauaaacuuauuauuaguaaacggugaagcgaggaaagacgguguaggaauuaaaaacacagaaauauucgaaaaauaucaagucgauguguuaggaaacauaaguaaagucaauaaggagaaaagagaaggaguaaaauga

SEQ ID NO: 5008 - RNA, 3216 nt, Artificial Sequence
  Cas9 variant
auggacuauagaaucggauuagacauagguacaaacagcauaggguggucgauaauagaacugaccaccguucagagcaaauuagauggcaaauauagacuaaaggcaguaggccuaauagaugcaggaguaagaauguuugacagagcagaaguuccaaaaacuggagcaucauuagcacuaccgagaagacuugcuagaagcucgagaagacgacuaacuaggagaucggcgagaaagaaagcaauacgcaacuuauugguaaaagaagauauacuaaaucaaauagaauuagaucaccuauaucggacguccgagcuuguugauauauggcaaauacgaguagaaggacucgaaagaagacucggacgacaagaaugggcaagauuauuaauucaccuuggacaaaaacgaggauauaggagcacuagaaaggccgaagaaggcgcagauaccgaaggaagggcaguauugaguucaauaaaagaaaaccaagaaacccuaaagcaauauagaacaguuggagaaaugugggccacagaugacaaauuuaaaggccgaguaagaaacaguacaaaugaauuuauauuuaacguaucaagagauaaccuagaagaagagauaagguuuuuguuccaacaacaacgagaacucgguucaauguaugcgucaaagcuauuagaagaaucauauauggaagucuggggacaucaacuaccauuugcuuccggcgagagcauauuaaagaauguaggaacauguagucuuuaugaaaaagaaaaacgagcagcuaaagcaacauauacauuucaauauuucauggcauuagauaaacuaaacaacguaagaauacuuccaucaaugcggacauuaucugaagaagaaagaggcuuagcccucaaagcaauguuugaacgagacaaauuaccuaaaaaucccccaaaguucacuuacagccaucuacgaaaagcaauaaaacuagaagaagacgaaaccuuucaaaccauaucauacgacguugagaaaacgcuagcgacaaacgagucagccgucuuuguaaaccuggcagcuuauuaucaaauaaagaaaguuugugaugaacacaaugaaaauuaugacuauguagauuauaacacaauaggccacgcauuaacuguauauaaaacagacgaagacauaaauaaauacuuagcaagcaaaaacaacauugcaaagcgaguauacgcuaacgacuucaucgauucaguacucaaacacucauacaccaccuuuggacacuuaucacuaaaagcacuaucacgaauaauaccccuaauggaagaaggagagguauuugcaaaagccaaagaaaaagcaggguucaaggaagaaagcuaccucgaaauaaagucaaaacuucuuacuaauauaccagacgcgauuaaaaauccugucguaaugcgaucuuuaacccaggcaagaaaaguuaucaaugcaauaauuaaaagaaugggagagcaaccagcaagcauacaaaucgagcuugcacgagaacuaagcaaggauguaagugaacguaaaaagauaacgaacggguucgcagaaaauagaaguagaaaccaauucgccauaaaaacauuagaagaaaaucacauaacaaauauacgaggacaagauauuguaaaguuuaaacuauggcaagaacaaggagggcgaugugcauauucacuaaagccaauaaaacuagaagaacuuaucucuuuucuuaagaaagaaagaagauaugaacauaaucuagacguagaucauauaauaccauacagcaaaacauuugacgacagcuauacuaauaaaguuuugguuuuuagcgacgaaaaccgaaagaaaggggaucaaauaccugcugaauaccuaggaauagguacaaaaagaugggaaaaauauaaagaauuuguaauuacgucaaaauucccggcaagcaaaaagaaacgauuguuaaaagaacaauuaguagagagagaagaacuauucaugaaagaaagacauuuaaacgauacacgauacgcaagcagauauuucaugaauuuucuaagagagaaucuacuuagaaaagaaacaguucuacaugaaacccaguggguaacagcaguagcgggaagaguaacaucccauaucaggaaacgacuaggauuugggaaagauagggaagaaacacaccuacaccaugcuuuggaugcuauaauagucgcgugcaccgacaaauggaugauugauuguguaaccaauuauuacaaauccagggaaggaggaaguauaaaaagaaaagaaauucgguuuccaucaccauggaacggauuuuggcaugauguacaaacuaaauuagcccagcugccacaaccugaaguuaucaaugaauccauaucaaaagguaacccagaugcagucgacuacaugcuuguaucucguaugccuagaaaaaguauaacuggcgcagcacacaaggaaacuauuucaaaauggggaggauacgacgauaaagggaaagcacuauuaguuaagaaaguagcacuaucagaacuaaaauuuaaaaaugacgacuuuccuauguauaauaaagaaacugauccuuuauuauacgaggcaauuaaaaaucgauaugucgaaaguggaagagacgugaaaagagcuuuugcuacaccccuauacaaaccuagcaaaagcggaaaacgaaaugaagugaaacgaguaaaaguaauagccgaaaagaaagcuauggucagagaagucaauggagggauagccgaaaaugguggauuaguacguucagauauauuccugaaagaaaagaaauauguaaugguacccguauauaccuucgauacgauuaaacaacaguuaccaaacaaauacguaguaagcggucgaggauaugaacaauggcccgaacuuacugcagaacacguauuccaguuuucuguauacccauacgagcuaguacauguaggaacaaacaaaggagacaauuccuucuauuacuucgccucauuaaauauaagcucaaacguacuaaaauucagcgaauguaauaggccaacaaaagacuauauagaaauaggccuaaauucaauaauccuguuagaaaaauacgaaauugacguuuuaggaagaauaaccggacagucaaagaaaggaauaagacaaaguuuuaaaaacaauaaaagccaaaugaaagaauga

SEQ ID NO: 5009 - RNA, 3219 nt, Artificial Sequence
  Cas9 variant
augcgacugggucuggacauaggaacaaauucaguaggauggugguuauauaaaaccgacggggaagcugccagcgcaagaauaguugagguuauagacggaggcguaagaauauuuagcgacggucgcgauccaaaaaguaagacaucuuuagcaguagaccgaagaguagcuagggcagccagaagaagaagagaucgauaccuacgcagacgagcaagucucaugaaacuucuagcacggacgggacucaugccugcagacccaguagaagcaaagaaacuugaaagacuagacccguaugaguugaggaguacaggcuuggaugaugcguuaccacuaacucauuucgggagagcuuuguuucaucuuaaccaaaggagagguuuuaaaucuaauagaaaaacagauagaggggauaaugaaaaugguaaaauacgagaggcaacugcuagacuggaccuugaaaugaugacaucgggagcaaggucguacggugaauuucuacauaugcgacgacaaagagcuucagacccucgacauguaccuucaguuaggacaagauuaucaguugccgcacguggaggaccagacgcgaaagcagaggcaggauacgauuucuacccagauagacaucaucuagaagaagaauuucaugcacuuugggcagcacaagcuacacaucaucaagcccuaacagacgacuuacgagaucuuguuuuugagaaaauauuuuaucaaagaccauuaaaagaacccaaaauaggguuaugucuauucacagcagaagaaagaauagcaaaagcacauccguuaacacaaagaaggguacuauucgaaacuauaaaucaacuaagagugacugcagaugggcggaguacaagaccauuaacacucgaggaacgugauacauuaguacacgcauuggauaauaagaaaccaacaaaaaguaugacuucaaugaauaugacacugaaggcuuuagcaaaauuguuaaaacuaagagauggagaaagauucacuuuagagacagguguuagagaaaauauaucgugcgauccagugagagcauguauggcacacccagcaagguuuggcccacaauggagcagcuuagauugggaagcucaaugggacguuauauccagaguucgucaaguucaaagcgaaggagaguucauagaacuuacugacugguuaauacaaggacacggauuagaugcugaucacgcuaaagcuguaggaaaugcaccauuaccagaaggcuacgcuagacuaggauucucugcaacagaacgcauuuuagaucaauuaaaagcagaaguuugcacauauuccgacgcaguagcaaaauguggauggcaucauucagaucaacgcacaggggcgugucuagaaguauuaccauacuauggagaaguguuagaucgccauguaauucccgguacuuaugaugcuacagaugacgaaauaacuagguaugggcgaauaacaaacccaacagugcauauaggucugaaucaauuacgaagauuggucaacaaaaucauagaaguacauggaaaaccagaccaaauuguaguagaauuagcacgagaacucaaacaaucagagccacaaaagaaagaugcuaugaaaagguuaagaaacacuacugcagaugcaauuagaaggucggaacaacuagaacaacuaggccaaccaaacacuggacauaauaggaugcuccuaagauuaugggaagauuugggaccagcaauaggaccaagauguugcccguauaccggaaaaacaauaagcguaacuaugguauuugacggaaguugugauguugaccauauauuaccuuuuucucgaacuuuagaugacucauuugcaaaucgaacgcuaugucuuaaagaagcaaauagagagaaaucggauagaacaccuugggaggcaugggguggaacugaucaaugggacgauauugccgcuaaucuaaagaaucuacccgaaaagaaaaggaaaagauucggacccgacgcaauggagugguuugaaggagaaaacgauuuucuagacagagcuuuaguugauacccaauauuuagcuaaaauaucaagaauguaccuagauacacuuuuuacaaaaggaggucaugucuggguugugccagggaggaugacagaaauguuaagaaggcauuggggguuaaacgcacuauugaaugauaaagaccgaggagcagucaaagccaaaaacagaacagaucauagacaucaugcaauagaugcagcagucguagcagcaacggacuaccgacucaugcaaaagauaaguagagcagccggacaaggagaaaaugcaggacaaagcgcagaauuaaucgcgcgagauacggacgcuccaugggaacacuuuagggcagacauugcaucacaacuugagaaaauaaucguaagccacagggcugaccauggaagaauagacguagaagggcgaaaaacgggaagagauucuacagcugggagauuacacaaugauacagcauaugguguuauugacgacuuaacaguagcuucaagaacaccgcuuaugagucucaaaccaagugauauagcaaucacagaaagagggaaaaauauaagagauccgcaauuacaaaaugccuuauauguugcuacuaaagggaaagaaggaaaaauguuugaacaagccuuaguggauuuugcuagcaaagaagggccauaccaagggauuagacgagugaggcuaguagaaacacuacaaaaggcugcuagaguggaaauaggaaagaccgaaucaggucaaccauugaaagcauauaagggagauuccaaucacuguuaugaacuauggaaacucccggauggcaaaauaguuccacaaguggugacaacauaugaagcacaugcaggcucagcuccaagaccucauccagcagcuaaacgaauacuucgaguauucaagaaagauaugguaaaacuuacgaaagauggcgaagaaauaguaggauacguacaaucaaugcauauuaaaaacggccuauuuguagcucaacaccuugaagcaaaugcugacgcaagaaauagagauaagacagaucccuuuaaguuucuccaaaugggggcaggaacauugguaaaaacaggacuuagaagaguccuaguagaugaaauaggaagacugagagauccggguccacccaagcuauga

SEQ ID NO: 5010 - RNA, 3225 nt, Artificial Sequence
  Cas9 variant
augcaaacuaaaaauuuaccauacacacuggggcuugacauaggaauggcaagcguaggugcugcauuacuccuacccgaccaagaaaggauauuagcccuacauguaaggacauuugauaaagcagaaacggcaaaggaaggagaaaguuuaaauaaaauaagaagggauagucgucuuacacgaagacgaauaaggagacgagcacauaggcuaguacgauuagcuagauuaaugaaaagaguuggacuaauagcggacgcaaauccugaggcauuugcgcucccaggugucaguccauggcauuuacgagcagacggacuagauagacuacuagaacccaaagaaugggcaggaguuuuguaccacuuagucaaacacagaggauuccaaucuaaccgaaaaagugaagcaaaggcagacgaaaaagcgggacaaauguuaagcggaguugguagaaaucaagccuuauuaaaagaagcaggauauagaacagucggagaauuggcagcaagacacgaagauuucaaagaggcaaaaagaaacaaaggagguaguuauagccacacauucgcaagagcagacuuaaaugcagaguuaaaucuuuuauucgaaagacagagagcacucgggucuagauuggcgagugcagauuuucaagaaaauguuagagaucuauuaauggcuagaagaccaacguuaaguggggcaaauuugcuuaaaaugguaggaaaaugcacguuugaaaaauccgaagaccgagcaccaaaagcgggauacagagcagaaagauuuguauggcuaggaaaauuaaauaauuuaaaaauugugggcaguggagacgcacguccacugacugacgcagaacacagaauugucauagacuuaccguuuacucaggcaaaauugacauuuaaacaaguaagaaaagcauuagagcuagaaacgcaccaaagguuuaaccuucugaguuacagaccagacccuaaagguaaagacaaagauccugaagagucaacauucuuugaagcaaagagcuuucauacacucaggaaagcguacgaaggugcaggccugaaaaaggaauggcaaagagacgccuuagaucccgauagguuagaugcguuagcauacgcauuaaccuguuacaaagaugacacugaaagcagacaaugguuaguagcacaagguauaggcacgccaauaauagaagccguauuagcagaaucuuuugacaaauuuauucauuuaagucaaaaagcucuaaaagcuauauuaccgcacauggaagcaggccaacguuaugaugaugcugcaaaaucagcuggcuacgaucacucgcaaccagacgcaggaaccgguaaacgggcaaccuugccgccuccagauaaagacaccauacgaaauccggucguauaucgagcuuuaaaucaagcaagaaagcuagucaacgcaaucguagcagaauauggaccaccagcagcaguccacauagaacuggccagagauuuaucaaaaccaauagacgaacggcgagacauagagaaaggucaaaaagaauuucaagcucuaaaagaaaaacucgcagcagcuuuugaagaaacuuuucaccgaaaacccucaggccuggauuuauugaaauauagacuauuuagagaacaauuagaucaauguccauacugucaaaaagcauuggucgucgacagauuauucgaaccugguuaugcacaaauugaucaugcauuaccauacucuagaucauucgaugacggcaugaauaacaaaguaguuguacacguagcgugcaaucaagauaaaggaaauagaaccccuuaugaauuucuagacggugcaggagacucagaaagauggcaacguuuuguagccuggguucaaggaaacaaagcaauacgacaagcaaaaagaaaccgauuauuaagagucaauuucgguaccgaugaggcaaaagaguucagcaaaagaaaccucucggauacacgauauauuuguagagaauuuaaaagaacuauagaaacacaauuugcguggcauucagacgcagaaggaaaugagagguguguaguacugagugggcaacuuacgagcuuacuaagagcuagauggggccucauaaaaguaagagaagauggugauuuacaucaugcauuagauguagcagucauagcugcggcgucucgaucauuaguaaagaggauggcugacuacucaagaaggaaugaacuagaaauggugcgaaauagauauguagauccugcaacaggugaaguaguagacguagcagcacugagacaaauagaagaccacuuucccaaaccauggccuuuauucagagaagaauuacuagcgcggcuggcaccagaaccaaaauuacaacugacuuguguaagcaguuaugaugaagguuugagagagaguauaagaccuauaaggguaaguagagcgccaacacggagaggcuuaggagcagcacaucaagaaacaauaagaagccuuagagaugguucacaaucugcaauuaaaacucccuuaagagaccuuaauuuaaaggaucuggaaaauauaguuggauuugagagagacacagcacuaauagaugcgauuagaacuagauuggaagcauuuggcggagaagguaagaaagccuuugaugacaaacagccuccacuaagaaaaccaaguaaagauccggacaaagcucccauaauaagaucaguaaaacuccuagugacacaaaaaucuggaauaccaaucagaggaggcauugcuaauaauggagcaauguuaagaagugauaucuuuacaaaagcggguaaauuuuaugcugugccaauauacguagccgaugcuguaaggggagaacuaccacauagagcagucgcgcaagcuaaaccagaacuagaauggcccaugauggaugaaaguuaucaguucuuauucucauuacauccaaaugacuggaugacuauccgauuaaagaaugaggucagagagggauacuacgcaggucuagauagagcgacgggaaacauaagccuauggcuacacgacagaaaccagaauguuggucaaaaaggacuacuaacaggaaauggaauaaaaaccgcacuagcagucgaaaaauaccacguugauuugcuaggcaaacuacaucgaguccauaaagaggaaagacagccuauacacauaaaaccaggcaaaagguga

SEQ ID NO: 5011 - RNA, 3234 nt, Artificial Sequence
  Cas9 variant
augaaauauucaaucggacuggauauugggauagcaagcgucgggugggcuguaauaaacgaagacaucgaaagaauugaagaucuugguguuagaauauuugacgucgccgaacagccaaaaacaggugcuucccucucaaccccaagaagauuagcuagaaguacaagaaaacgacuaagaagaagaagacaccgaguagaaagagugagaaaauucaugauacagaaaggccuacuuacccaaguacagauggaacaauuauaugauuggaaagauggagaccuagacauauggcuaguaaggguaaaugccuuagaaagaaaauugucagauagagaauucgcacgcauacuuguacacuucgcaaaaaacagaggauuccaaaguaaucguaaaucagaacugcaagaagaagacaauggagcuguauugagcgccguacaagaaaauaaaagacucauggaagaaaaaggauaccagaccauauccgaaauguuacuauaugacgaaaaauuugaaggaacaaaaagaaacaaaggaggagaauacacacauguaguugcaagaagcgauuuaaaaagagaaauacaauuaauauucgaaaaacagcgagcguacggacacgcauuugcaacaauggaaaaugaagauaaauuccuucaaauauggucaagccaaagaccguucgccacuaaagacgauauagcaaaaaaaauaggaaauuguacauucgaaccaaaagaaaaaagagcacccaagaguacauacacuuuugaaagauuucgugcacuggacaaacuaaauagacuaagaauacuaucagguacaucaccggcacguucauugacacaagaagaaagggauuugauacucaauucucuuuucagcaaaaaagaaguaaaauauaaagaacuaagaaaauuauuaaaauugaacgacgagcaaagauuuaaugaaauauucuaugaccccaacgaaaaaauagaaaaaaaugaaaacagaacguuccuaucauuagaaucccaauauaaaauacgcaaaauucuacaaaaaauagaaggcaaaucauugaacgacacauaccguccagucgacuuagauacgaucgcuuacgcacuaacaguauucaaagaugaccaagacaucagagauuauuuacaaaaccaauauguagcuucuaacggcaaaaaagaauuaaauuuagcaaaucgaaaguauaaugacgaacuuaucgaagaacuacuucauuuaucauuuacuaaauuuggacaccuaucacuaaaagccuuaagaaacauacucccauuuauggaacaaggaauaccuuaucaccaagcgugugaaaaagcuggcuaccaauucaauaaaaaaguaaacagagaaaaacagaaacuauuaccucccguaccagccaaagauauagucaauccaguaguuauuagaaguuuaucacaaguaagaaaaguaauuaaugguaucauuaaaagauauggaucacccagcagcauuuacauagaacuugcccgcgaaaugggacgagguuacaaagaacgaaaagaccuagaaaaacaauauaauaaaaauagacaaaugaaugaaggagcaaaaaaacacaucuuggaacuuagaccugaauuuggagacccuagaggccacgauauacuuaaauacaagcuauggcaagaacaagacugccgaugcgcuuacucauucaaaucuauaccgauuaaacaguuauucgaaauagguuacgcugaagucgaucauaucauacccuacucuagaaguuuugacgacaguaauaauaacaaagucuuaguacuggcagccgagaaucaaaacaaacaaaaccgaacaccuuaugaaugguuuggucacgaugaaacaaaauggcaggaauuuaccucacuuguaacaacaaugaagguaagcaaaaagaaaaagucuuuauuauuaaagaaaaauuuugacgaagagcaagcagaagaauucagaaguagacaccuuaacgauacacgauauauaacaagauacaucaaaacuuuuauagaggacaaccuacaauuccguauagaagaggguaaaaaaacauauguacacacaguuaacggugcguacacaucgcugaugaggaaacgcuggggauuuaauaagaacagacaagaaaaugcuuuacaucaugcauuggacgccgucauaguagcaguaucauugccauuuaaacacaagguaagagcauacuuuaaaagaagagaagaauacgcucacaaccagcuaaaaagagaaggagaguuuuuuccagaaccuuggccagguuuuauacacgaacuugaaaucagaaugaugcaagacucagaaaacaucaaacuagcaauggaaucuuugaacuuaaaaacauacgaugaaaguuucauaaaagagcugaaaccaaucuuugucaguagaaugccaaaaagggcaaugaaaggacagauacaugaagaaacacuaaaacgaguacggggacggacggacgauggauacauaagaaccgugaagaaagucaaacuggaccaaauaccuuucgacaaaaacggagacuuccccauguucgggaaagagacagacaugaaaacauacgaggcaauaaaaagucgguaucuagaaucaggaaaagacaaaaaaaaagccuucaauacaccucucuacaaaccagcaaaaaaucccgaaaaugcgccuauaauaagauccauaaaaauagaagagaaagcaaaucgaguggugaugcuagacgaaaaaaccgcagcagacaacgcaaguauaguucgaacagaaguauuuagacacaaagagacaggaaacuacuuccuuaccccuguguauguagcagauguacuagcaaaaaaagucccagaucgucuaaucacaacgaaaaaacccuauagugaauggcgcaaaauaacagacgaauaugaauucuuauucagccuuuaccccaacgaccuuaucagaguaaaaaugccaaaagaaaaagaaacaaagacucacacaggagaaaaacauguauggcaagaaaauuuuauguacuucaaaggaguacauagcggaagugcaggaguaagaaugauugaccauaugaacucauuugaagaugaaauuggaguacgcaaauuagucguauucgaaaaauaccaaguagacccgcuagggcgaaugaacaaaguacauggcgagaaacgacauggaaucuga

SEQ ID NO: 5012 - RNA, 3234 nt, Artificial Sequence
  Cas9 variant
augaaauauaguauaggacuggacauaggcaucgccaguguugguugggcaguaauaaaugaagacaucgaaagaauagaagacuuaggaguaagaauuuucgacgucgcggaacaacccaaaacuggggcaucacuaaguacaccaagaagauuagcaagaucaacacgaaaaagacuacgaaggagacgacaucguguagaaagaguaaggaaauuuaugauccaaaaaggccuucuaacacaaguucagauggaacaauuauaugacuggaaagauggagacuuagacauuuggcugguaagagugaacgcuuuagaaagaaaauuaagcgaccgagaguucgcgcgaauacucguccauuuugcuaaaaauagagguuuccaaucaaauagaaaaucagaauuacaagaagaagauaauggagcaguauuaucugccgugcaagaaaacaaaagauuaauggaagaaaaaggauaccaaacgauaucagaaauguuacuauaugaugagaaauuugaaggaacaaaacgaaacaaaggaggagaguauacacauguuguugcgaggucagaccuaaaaagagagauucaacuaauauucgaaaaacagcgugcauaugggcacgccuuugccacuauggaaaacgaagacaaauuccuccaaauuuggucaagccaaagaccauuugcgacaaaagaugacauagcuaagaaaauaggaaauugcacauucgaaccaaaagaaaaacgcgcacccaaaucaacguacacuuucgaaagauucagagcacuagauaaacuuaauagauuaaggauucuaagcggaaccucucccgcaagaucauuaacucaagaagaaagagaucuuauuuuaaauagccuuuuuagcaagaaagaagucaaauacaaagaacuaagaaaauuacugaaauuaaacgacgaacaaagauucaacgaaauuuucuacgaccccaacgagaaaauagagaaaaacgaaaacagaacauuuuuaucgcuugaaucccaauauaaaauuagaaaaauacuacaaaagaucgaaggaaaaucacuaaaugauacuuaucgacccgucgaccuagacacaauagcauacgcuuuaacuguauucaaagaugaccaagacaucagggauuacuugcaaaaucaguacguagccucaaauggaaagaaagaacugaacuuagcaaacaggaaauauaacgaugaauuaauagaagaacuacuacauuuaucauuuacaaaauuuggacaccuaucacugaaagcauugagaaacauacuuccauucauggaacaagguauuccauaucaccaagcaugugaaaaagccggauaccaauuuaacaagaaaguuaaucgagagaaacaaaaacuucuucccccggugccagcuaaagacauagucaacccagucguaauuagaucguuaagccagguaaggaaaguaauaaacggaauaauaaaacgauacggaagucccaguaguaucuacauagaacucgcacgcgaaaugggaagaggauacaaagaaagaaaagacuuggagaaacaguacaauaaaaaccgucaaaugaacgaaggugcaaagaaacauauacucgaauuacgccccgaguuuggggauccaagaggccacgauaucuuaaaauacaaauuauggcaagaacaagauugcagaugugcauauaguuuuaaaaguauaccaauaaaacaauuauucgagauaggauaugcagaaguugaucauauaaucccauacagccggaguuucgacgacaguaauaauaauaaaguccuaguacuagcugcggaaaaucaaaacaaacaaaacagaacaccuuaugaaugguuuggacacgaugaaacuaaauggcaagaauuuacaagucuaguaacuaccaugaaaguauccaaaaagaagaaauccuuacuguuaaagaaaaauuuugaugaagaacaagcagaagaguucaggucaagacaccuaaacgauacgagguauauaacacguuacauaaaaacauuuauagaagacaaccuacaauucagaauggaggaaggaaagaaacaauauguacacacaguaaacggcgcauauacaucauuaaugagaaaaagguggggauucaauaaaaaucgacaagaaaacgacuuacaucaugcacuagacgccguaauaguagcaguaagccuaccauucaaacauaaaguaucagcauacuucaaacguagagaagaauacgcacauaaucaacugaaaagggaaggggaguucuuuccugaaccuuggccaggcuuuauacacgaauuagaaauaagaaugaugcaagacucagaaaacauaaaauuagcuauggaaaguuuaaaccuaaaaacuuacgaugaaucauucauaaaagaacuuaaaccaaucuucguaucgaggaugccgaaacgagcgaugcgaggucaaauacacgaagaaacauuaaaaagggucagaggaagaacugacgacggauauaucagaacagucaagaaaguuaaauuagaccaaaucccauucgauaaaaauggagacuucccuauguucggaaaagaaacugauaugaaaaccuacgaagccauaaaaaguagauacuuagaaaguggaaaagacaaaaagaaagcauucaacaccccgcuauauaaaccagccaaaaacccugaaaacgcacccaucauaagaucaauuaaaauagaagaaaaagcgaacagagucgucaugcuagaugagaaaaccgcagccgacaacgcaucuauaguacgaacagaaguauucagacacaaagaaaccgggaauuauuuucuuacaccgguuuaugucgcagaugucuuggcaaagaaaguaccugauagacuaauuacuacuaagaaaccauacucagaauggagaaaaaucacagacgaauaugaauuucuguucucgcuguacccaaacgaccuaauacgaguaaaaaugccaaaagaaaaaggaacaaaaacacauacuggugaaaaacacguauggcaagaaaacuucauguauuuuaaaggaguccauaguggaucugcaggaguaagaaugauagaccauaugaacucauucgaagacgaaaucggaguaagaaaauuagucguuuuugaaaaauaucagguagacccucuagguagaaugaauaaaguucauggcgagaaaaggcacggaauauga

SEQ ID NO: 5013 - RNA, 3234 nt, Artificial Sequence
  Cas9 variant
augcaacaaaaaccacaacguuauauacuuggcuuagaucuagggauugcaagcguaggaugggcuuguguaugggcagacgaaaaugaacauccaacaggauuguuagauuguggagugaggacauucgaaagggcagaaguaccuaagacaggagauaguuuggcuuuagcaagaagacaagcaaggagcguaaggcgcuuaauacgaagacgagcacauagauuauuaagacuaagaagacuacuaaagagagaagggguuuugcuaagugcagauuuuaacgaaaauggucuagugaggggacucccuaucgacgccugggcacucagaguggcaggauuagauagaaaguuauccaauaaagaaugggcagcaguacuuuuacacuuaguuaagcacagggguuaucuaagccaaagaaagaaugaaacucagucgaaagauaaagaacuaggaagauugcuagcaggaguaaacggaaacagagaagcacugcaaaacaggucagacgaauacagaacagccgccgaacuagcaguuaagaaauucgccgcugaaaauaacgggucgcuaaggaauaaaggaggagauuauagccacacauuugauagaaaagauuuacaaagagagcuacaucuauuauuugaacgucagagagcacuggacaauccauuuacaaguucagaaauggaagcagcaguggaugaauuauuaaugaaacagagauccgcacuucaaggugaagcagucuuaaaaaugcuagguagauguacauuugaaccgagcgaauauaaagcagcuaaaaauacguauucagcagaaagauuuguaugguugacaaaauugaacaauuuaaggauucaauauaauggagaagagagagccuuauccgaagcagaacguaggcuucuuuuagaugagcccuaucaaaaagcuaaauuaacauauaaacagguaagaacaauccuagaacuuccagaaagugcagucuucaaaggguuaagauacggccacggagaagaugguuuaaaagcugaaaguggaacacuaauggagaugaaggcauaccacgcggucaggaaagcauuaaaagaugcaggacuugaaggagaaugggaaaauaggauacggaacccagaauuacucgaugccauaggcacagcguucagucuauauaaaacagacgaagauauuagagcaaauuuagcugcuuuuagacuuucagaaaauguacuugaagcguuauuagcaggauuaaauuucgauaaauuuguucaccucucucucaaggcucuggcuaaaauauuaccguuaauggaacaaggaaugcgauacgaugaggcaugcaaggaagcauacggagaucauuacggugccaaagaacaagaagaucaccgacuauuaccaccauucguugcagacgauauaagaaacccuguuguuuucagaacuuugacacaagcaagaaaaauuguaaaugaaauaguuagaagauauggauccccucuuagaguacacauugagacagguagggaagucggaaagagcuucagugaccgaaaagaaauagagaaaagacaagaagaaaaccgaaaagaaagagaacgugcagcagcacauuuuaaagaacuuuuuccuaauuucgccggugaaccgaaggcacaagacauacugaaacugagauuauaugaacaacaacauggaaaauguuuguauucaggaaaagaaauagaccuaagaagauuaccagaaaaaggguauguagaaaucgaucaugcacuaccauuuucgagaaccugggacgauaguuuuaacaacaaaguucucguauuagguaaagaaaaccaagacaaaaggaacagaacuccauacgaauauuuagacggaaaaggcaauaguggagcauggagagcauucgcagaacgagucucaggaugucgauuuccguaugcaaagaaacaacgacuuuuaacgcaaaaacuagaugagaaaacagaacaaggcuuuuuagaaaggaaucugaaugacacacgauaugucgcgagauuuuuaugucaauuuauagaagagaaaaugcacuuggaaggugcaggaaagaaaagaguauuugcuucaaacggucaaauaacagcgcuauuaagagguuucugggguuuaaagaaaguaagggaagaaaaugauagacaucacgcucuagaugcaguagucgucgccugcaguuccguaaguaugcagcagaaaauaacacgacauuuucgauauagagaagaauuagaacauauagauagagaaacaggagaaguaauccauggauuuccacaaccaugggaauuuuuccgccaagaagucaugacaagaguauuuagugaugauccaguaucugaauuagcagaaaaauuagacagucgaccagaagcaguucaugaauuuguaaccccucuuuuuguaucaagagcaccacacagaaaaguaacaggccaaggucaccuugaaacaauuagaagugcaaaaagacuagaugagaaaauaucaguaguaaaauuaccguugacacaauuaaaaacaaaagacauagaaagaauagucggauauccaaacagagaaccagcacuauaugaugcucuagcagcaaggcuagcagcauuuaaagaugauccagcaaaagcauuuagugaaccauucuauaaaacuggaaaagauggaaaaugcgggguucuagucaaagcuguaagagucgaaaauguacagaaaucaggacuuuugguaagaaaagaugaaagugguaaaaugcaaggaguggcagauaacgcaacgaugguucgcgucgauguuuucgguaaaaacggaaagaauuacuuaguaccaguauaugcauggcagguugaaaaaggugaacuuccaaaucgcgcaguaguagcauaugcagaugaagaagauugggaugaaauggaugauaguuuugaguucaaauuuaguuuauacccaaaugaccuaguagaaguugugacaaagaaagacaaauucuuuggauauuauucaggauucaauagagcuacuggugcuauaaacauuaaagaacaugauuuaagcaaaagcaaaguuaaaaauggaguauacgaagguaucgggguaaaaacugcccaaaguuuucaaaaauaucaaguagauacauuggguaaaacuauccgauuaugcaaacccgagaaaagaaugggcuuuaaaaagaaauga

SEQ ID NO: 5014 - RNA, 3237 nt, Artificial Sequence
  Cas9 variant
augagauauguuuuaggucuagauauaggaauagcuucauguggaugggcugucauaaaucaagaaaaagaacgcauagaggaccuaggaguaagaauuuucgacaaagcagaaaaucccaaagacggcaaaucacucgcagcacccagaagagacgcacgcucuacaagaagaacacucagaagaaagaaacaccgaaugcaacggaucaaagucuuacuuguaaaacacggauuauuaucaaaaacagagcuagaccauuuauacgaaucagcaacugaaguagacguauggaacuuacgauuagacgccuuagaacguaaacuguacccaaaagaguucgcacggauacucauacaccucgcgaaacgaagaggcuucaaaagcaaucgaaaagaaacgacccucagcgaaaauggucagauauuagaaucuaucucagaaaaucaacaaauaauggaaaaacagaacuaucgaacgguaggagaaaugauacugaaagacaagaaauucgaaaaucauaaaagaaacaaaaauggaacguacguagguacaguaacaagacaacaacuccaagacgaaauucaaaugauauuccacgcacaaagacuuuacaaaaacgacuacgcuacagaggaauuugaaucuucauacuuagaaauaugggcuagucaacgaccauacgcaucgaaagaccagauagagaaaaugauagguuauuguacccuagaacccaaagagaaaagagcacccaaagcaagcuggucauuucaauacuucgucgcucuccagacaaucaauaacuuacgacugauaucaaaagaccgaauagaagaacuaucauuugaagaaaagaaacagauaaugaacuuagcacuugaaaaauccauaguaaaauauauagauaucagaaaauuacucucuguaccaaacgaauuucaauuuaacucacucucuuauuccgcagauaccguagacacagcagucgaaucacgaaaauguauagaauuaaaagaauaucacucgaucaacaaaguauauaaacaaauauauggcgaaaaugcauuaaaccuucuuccuaaauacuacgauacaauagcguauggacuuaccauauucaaagacgauaaagauauacuagaauacuuacaaaacaaauauguaaacgcaaaaggaaaaccuauaucaaauuuugcaaauaaaacauaugaugauacauuuauucaagcgcuacucaacuuaaacuuuaccaaaaugggacaucuaucauucaaagcccuuaaaaacauuaucccauuucuagaagaagguuuaagcuacgacaaagcaugcgaaaaagcaggauacaacuuuaagggaaccuccuacacagaacaaacaaaauaucuaccugucauaccucaaaacacaaacccaguaguccacagggcacuaagccaaaccaggaaagugauuaacgcaauuauaaagaaauauggcucuccaaacgcgauucacauagaaacugcaagagaacucucuaaaacauuucaagaacguaaagaaaucgacucuauguaucaagacaauucuaagaaaaaugaacacgcaauccauaaacuaaaagaacuuggaaacauaaaccccucgggaauaaacaucgucaaauuuaaacucuggaacgaacaagacgguagguguauguacucaggaaaauauaucgagccacacagacuauucgaagaaggauacacagaaguagaucacauucuaccauauucaagaucauuagaugauagcuauaauaacaaaacccugacauuaggaacugaaaaccaacgaaaaggaaacaaaauacccuacgaauauaugggaaacacaucuauauggaaugauuucgaaacacgagugcaaucaaacaagaaaaucaacaaaaagaaacaacaaaaacuccuuuuacaacacuucucuuaugcucgagaacaagaguucaucgaaagaaaccuaaaugauacgagauacgcuacuauauacuuaagcucacugauacaacaacaucucaucuuuucagaaaguucaaggaaaaagaaaguacacacuguauccgguauaaucacaucacaucuaagauccagaugggguuucaauaaagauagaaaagaaggacacauacaucaugcacuagaugcuguaauaguagcuguaacauccgaccacaugauccaaagaguaacaaaauauuauaaauuaaaagaacuuaauagaaaucuacaagcaaaaagaaugccauuccccgaacccugggaaggcuucagacuagaauuagaagcccgaauauccccaaauacccaacaguaccuuaaaggacuucgauuuaaaaacuaugcagacgucaaccuaagcgaaauaaaaucaauauuuguaagucgcaugccaaaacacucgauaacuggagaacuacaucaagaaacaauaaggaaauucauaggauauaacgaaaaagggaaaguauuaacagccauuaaaacaaaacuagaagacaucccauucgaugcaaauggagacuuccccauguaugguaaagaaucagauuuauauacauacaacgccaucaaagaaagauaccuaucgcacaagaaagauaaaagaaaaucauuucaagaaccacuuuauaaaccuacaaaauccggaggaauaggaccucuaaucaaaucaauaaaaauaauggauacaagaacaauugugaaccccgugaaucaaggaaaaggaguugucuacaacuccaaaaucgcucgaaccgauguauuuaagaaagaagagaaauauuaccuuauucccauauacacaauagauuuaaugaaaaacauccuuccacaaaaagccauaacagcaggaaaaggcuacgaagauuggacaacaauagacccuuccuucacuuuucuauucucauuauuccccaacgaucuaauacaaauugucccuucuaaaaauaaaaccauaaaagcaagaacgaccguuuccaagaaagaaguauuacucccaucacuuaccggcuacuuuaaaggcguucauucaggaacagcaggaauaacaguagaaacacaugacgggucaguuauagcaaaugucggcagcaaacaguuacuuuuaauagaaaaauaccaagucgacgucuuggguaacuauacuaaaauaaaagaagagaaacgcaucgguuuaacaacauauaaugauaacaagaaaauagcagcuugcuga

SEQ ID NO: 5015 - RNA, 3237 nt, Artificial Sequence
  Cas9 variant
augaaacaacaaccacaaagguauauucuaggccuagauuuaggaauugcaucaguagggugggcacuaauacuuguagaugaagaaggcaaccccauaggacuacuagacuguggcguaagaacauucgaaagagcagaaguucccaaaacaggcgauucgcuagcacuugcaagaagacaagcaagaagcguaagaagguuaauccgucgcagagcucacagauuacuaagacuuagaagacuucuaaaaagagaagguguauugucagcagcugacuuuaacagcgacggauuaccuaaucuaccaauagacacauggcaacuacgagucgcuggccuugaaagaaaacuaacaaaucaagagugggcagcaguccuuuuacaucuagucaaacauagaggauauuuaucccaacgaaaaagcgaaacacaaacagaaaacaaagaauugggauguuuacuugcaucaguugccaaaaauucaaaauugcuuucggaaaaugcaaaccaauaucgcacuccggcggaguuagcaguucgccuauuugccgaacaaucaggucacuuaagaaauaaaggaggagauuauacucauacauucaaccgacuagaucuacaaaaagagcuucaccucuuauucgaacaacagcgaacauuuggaaaccccuucgcuagugcagaauuacaaucaaaaguggauggccuuuuaaugaugcagcgcagugcacuacaaggagaagcuguacuaaaaaugcucgggaaaugcacguucgaaccaagcgaauacaaagccgcuaaacacacauacucagccgaaagauucauaugguuaacaaaacuaaauaauuuaagaauuuuagaaaacggaacagaaagagcgcuuaaugaagcggaacgaaaauuauuacuagaugaacccuacaagaaagcuaaacuaacguauagccaggcacgcaaauuauuagauaugagucacgaugcaacauuuaaaggacuaagauauggaaaagacucggaaggccucaaugcagaaaacggugcuuuaauggaaaugaaggccuaccauaaaauacgaacuguucuagauaaagcaggacucaagggagaaugggaaaaucgcauuagaaauccagaaauuuuagacaagauaggaacagcauuuucacucuauaaaacagaugaagauauacaagcagcgcuugcagaucuuagacuuccagaaaauguacuuaacgcacucuuagcaggacuaaacuucgacaaauucauacaacugucacuaaaggcauuaucaaauauaaugccauuaauggaacguggaauaagauacgacgaagccuguaaagaagucuacggagaccauagagcucuagcagaaagcaaaaaccaaauguuacuucccccaauaccggcuaaugagauuagaaaucccguuguacuccgaaccuuaacucaaacacguaaaguaauaaacgcaauaauucguagauauggaagcccgcaacguguacacauagagaccgcaagggaacucgguaagagcuucaaggauagaaaagaaaucgaaaaacgucaagaagaaaacagaaaagaaagggaaagagcggcagaacauuucaaagaacucuucccucauuucgcaggggagccuaaggguggagauauacuuaaacuaagauuauaugaacaacaacaagguaaaugcuuauauucauccauaccaauagaucuuggaagguuaaaugaaaaaggauacgucgaaauagaccacgcuuuaccuuuuagucgaacaugggacgauaguuuuaacaauaaaguauuaguauuagguucagaaaaucaaaagaaaagaaaucaaacaccauacgaauaucucgacggggcuagcaacagucaaagguggcgggaguuccaagcacgauuacaaggaugcagauuuucauaugcaaagaaacaaagaauccagacagcaaaacuugauaguaaaacagagcaaggauuuuuagaaagaaacuuaaaugauacuagauauauagcacgguuccuaugcgguuuuauugaggaaaaccuacacuuacaaggggaagguaaaagaagaguauuugccuccaauggccaaauaacagcuuuacuaagaggacuauggggcuuaaagaaaguaagagaagaaaaugaucgacaucaugcauuagaugcaauaguaguagcauguaguacugucucaaugcaacagaaaauaacaaaagcuaugcaaagaagagaaacuuuagaaacaguagauacagaaacaggagaaguaaaaacacgaauaccacaaccaugggacuucuuucgucaagaagucaugaugagaguauuuagcgauacaccccacgaagaacuggcggaaaaauuaucuggaagaccugaagcauuacaugauuucguaaguccacuguuugucucacgagcaccuaauagaaaaaugacgggacaaggucaucucgaaacaguuaaaucugcaaaaagauuaagugaaaauauuuccgucgugagaaaaccacuaacugcauuaaaauuaaaagauaucgagaauauagucggauauccagauagagaaccagcauuauaucaagcguuacgugaaagauuacaagcauacaaagaugauccaguuaaggcauucgccgaacccuuuuacaaaccugccaaaaauggugggcaaggaucucuagucaaagcagucagaguaaaggacguacagaaaacaggagucaugguuagaaaagaucgcgguggcauugcacgaggaauagccgauaaugccacuaugguaagaguagauguauucgguaagaaagguaaaaacuaucuaguucccgucuacgcuuggcaagucgcaaaggguauauuaccaaacagagcaguaguagcauacgcugaugaagcagacugggaugaaauggaugacucauaugaguucaaauuuacguuguauccaaacgaccuggucgaaauuauaagcaagaaaggaaggauauucggauacuauaguggauuaaaucgagcaacaggcgcaauagauauaaaagaacaugaccuaucuaaagaaaaagcuaaaaaugguauacaucagagcguaggaguaaaaacuguacuaucauuucaaaaauaucaaguagauccacuugguaaagaaaucugcuugugcaaaguagaaaaacaucccgaguuaaacagcaaaaagaagaaauga

SEQ ID NO: 5016 - RNA, 3237 nt, Artificial Sequence
  Cas9 variant
augggauacuuaaucgguuuagauaucggaauuacaaguguaggauacgcaguacuccaaaccgacuuuaaagggaacccguacaaaaucuuacucaugaauacagucauauucccaguugcugaagcaccuaaaacuggggaaucacuugccgcaccugugagacagaaacgauccucucgacgcacuaacagacgaacaaaauuccgcaaauugcgaguacaaaaacuauucguccgauucggacuccuagaauccgcugacguugcaacauuucuaaaucaaaaagucccccaucaagauaucuggcaauuaagaaaagacgcucucaaccgcaaauuaucaaacagagaacuauucgaaauacuauacuuuuucgucggacaucgcggauuuaaaucuaacagaagaagugaaguaacagguaaacaaccaaaagauaaccaaguaguacucacgucgauccaugaccgcggcaacacuuuaaacgauuucgacucgcucggagaaaugaugcaagaauuacccgaguucaaaacaauaaaacauaacaaagcauaccguccagacaauacuauauacccauuacgugcauggaucgaacaugaacuuucugccauauucucaguccaacagaaaaacaauagacaaaucaccgauaauuuuauaacucaauaccuugauauauucagaucacaaagagauuucgaccaaggcccagcagcuccaaguagauucggaggaaacaugauagaaagaaugguaggaccggauucucucgacgcccacgagaaaagagcagccaaauuaaccaacacauucuuuagauuuaacuuucuaucaacacuuaacaaucuuaaaauccaacucacacuuggcgccgaauuucacccacucacaacaccccaaagagaaauaguacuccaagcagcgacccucaaauccuuaaacuacaaacaaaucagacauaaacuacaauuaccugacucagcccgauuuaaccucguaccauaucaaucuaacgaagacccaauaaaaacagaaucaaaacauuauuuguucaaacgaaaagccuuaacacaaauagaagccguaaccgacaacccacaacuaaucgauaaaaucggcacaauacuagcauauuucaaaggagacaaaacccgacaggaaaaacugagcgcacucaaccucucaagagcagaaauaaaacaacuuuugccaaucaaccaaccaggauucgguaaucuaucauuaaaaacaaugcacaaaauucuaccauauuuagaacaaggccaucuauaccaugaagcagcacaacuggcuggcuaugacuuucaaaacaaccucguugacaggcaauaccuccgggauaaucucaaaaaccccguaguaaacagagccaucggaaaaacaauaaaaguaguaaacgcaauuauaaagaaauacggggaucccgacgccauacauauugaacuaacacgagaaaucaaacacucucacgaagagagacagaaaauagcaaggcaaaugaauaccaacauggaucaaaaugauaaagucgccgaacauuuaagagaaaacggaauacccguaaauggucaaaacauaauuaaaucaaaauuauucuaugaacaaaaaggaauagaucuauauaguggacaacaaaucaacgaacaagacuuauauacugaagaccauuaccaaguagaucacauuauaccauauucaauaucauucaaugauagcuucaccaacaaaacugucacgcgaacaucuaacaaucaaaacaaagcaaaucguuuaccacuagaauaccucagcgaagagaaacaagaugcauuuagagcaagagucaugagcaauauaucaaacuacagaaaacgacaaaaccucuuaaaagaagguauaacugaagauaaccgacaacaauggaaaacacguaauaucaaugauacaggauacauaaaucgauuacuaucccaauaucucagaaacaauguacaauucacuaaaaagucucauaacccuguguuuacagucaauggagcaaccacagcuuacauuagaaaaagguacgguauaauuaaaaauagacaagcaacagaccuacaccaugcaguagaugcaguaaucaucggcuguaucucaaacacauucguaucaagacuugccaaauauucugaagcacaagaagcacgauaucacaaacaacuauggcaaauaacacaauauagacaagaacauaaagacuuaucaaccauagaguaccaagaacuuauaaaacaauucccacucccauggccagacuuccgacaugaguuaauggcucgucuaaguacagacccagcaaaaaugauggcucaucacacaugggaacacuacacagaugaagaaauaagccaacuaaaaccagccuucguaauaagaucugcuaaccacaaagugacaggaucugcucacgaugacacaauuuacagcaagaaacuauaugaccaacguggaguaggcuuacuucgaacaucucuacaaaaucuaaaauacgacagcaagaaagacggaauuaaaaacuacgaacggcuaaaagauggcagcaacagucuagucuaugacucauuacuccgugcccucaaagaacacgacggaaacgccaagaaagcauucccggacaaccaacuacuaauuucgacaggaaaccaucagcaaauuauaacacacgucaaaacaguaaagaaaauaacccacccuauagaaguaaaucgagacacagcuauugcaauaggaggaagaaugaucagagucgacauuuucaaacaagcaaaagcccaaaaauuaauuggaauaccaguauacguaaaugacacagucaaaccaacccuaccaaacagagccugcaccagugguaaaagauauucagacugguaucaacucacaagacaagaucaauuucuuugcuccuuagugucaaaugaccuaguccucguagaaacugccucuccauuaaaagucacgaacaacauuacaaacgaagaaguacaaacuacucaacuacuguguuacuuuucuagcuuuaauauagccaacgcacaaauaaacuuccauaguauuaauaaugacuccucaaucaauccaauaguacuaaacaaaguaacauauuuaacaaaauaucaauuagacuauuuaggaaacuacuuuccaguaaaacaugaaagcagaaaaacuuucaauagaaaaagauga

SEQ ID NO: 5017 - RNA, 3237 nt, Artificial Sequence
  Cas9 variant
augcacacaagacuagcauuagauauaggaacaaccaguauaggauggauccuauaugaauugguaaacggacagccagcguccauauuagacggaggaacucgaauuuucagugaugguagagaagcgaaaacaggacauucuuuagcggucgggaggagaacagcccgagguaugagacgucgacgagaucgguacuuaagaaggcgugcagcauugaugaaaagacuagcagcaauaggcuuaaugccagaaucuccagaagcugcagcucaacuagcaacauuagauccauaugaauuacgagcuagaggauuagaccauccauuaccaccagagcauuuaggacgagcuuuauuccaccuuaaucaaagaagaggauucaagaguaacagacgaacagauaaaggaaauaacgaaggggguaugauugcggacgcgucagcacguuuagagcaagcaaugauggcagcuggugcccguaguuacggcgaauuuuuacacaagagacgagcagaagcgacggcuccaagagccacucccgcaguuagaacaagaauuaauccgcaucugacuggagaagaugguaaggaacaaccagguuacgauuuuuacccagauaggaaacaccucgaagacgaauuucauagauuaugggaagcucaagcuagacauaauccagaucuaacuccagcaaugggggauuugcuuuuucaaacuauauuucaucaaagaccucucaaggcgccugcaguuggaagauguuuauuuuuggaugaaccaagauuaccaaaggcacauccacuaacacaacagaggacacucuaugagacagugaacauguuaaggauugcaccaccaggucaaccuaaaagacgucuuucuagaguacagagagaucaaauaguacacgcuuuaaauaauagaaaaauacuagcaucaccaggaaagaacguuuuaaccuuagcagccauaggaaaacuacuaaaauuacgaccaggagaagcauucagcuuagauacugcaaacagagacgcaauugccugcgauccuguacgaaugaguuuagcauaugaaggaagauuugguccacaguggagugcauuaucaguagaaucacagugggaauuaauacagcgucugagagaugaucaagauggagcagcacucguugacuggauaauggaucgcuacggauucgacagagauagagcaagagcaauugcagacgcuccucuaccggaaggcuuuggacgacucggugagacggcaacaagagcaguuuuggcuguauuaauaggggguaccacagagcaagaaguuuuaaccuacagugaagccguagcugcauguggaugggaucauucgcggcuaggaacaggggaaguucuagauagacuuccauauuauggacaaguauuagacagacacguucuacccgguacgggcagaccagaagacgaugaaauaacaagauucgggaggauaacgaauccaacaguucauauagggcuagggcaaguaaaaagacuuguuaauaaaguaauugacgccuggggacgaccacacgaaaugguaguugaauuagcuagggauuuaaaaaugagugaagaucaaaaacgcaauuuagcaaaaguaaacgcccaaaaccaacgagcagcagaaaugcgauccgcaaaacuuauaggcgauuuaaaaauagaagacaaugguaggaauagagguauacucaggguaugggaagagagugcagccgauguauuacacagauguuguccauauacaggagcccaaauaagugcguccaugcuauuugauggaucaugugauauagaucacauauugccauacucaagaacacuugaugaugguuuuaacaauagaguuauauguuuaaaaagugcaaaccgggagaaaagaaaccuuaccccaugggaagcauggggaaauacaccuaaaugggcugcaauagaagcaaauuuaaagaauuuaccaccggcaaaagccuggagauuugcuccagaugcaauguuaagauaugaaggagaaagagacuuuacagcaagagcauuaguagacacgcaauacuuaucaagacuagcccgagaauaccucgaguguuuauaugcggaggacauagauccugggccacauuccgguaagaaaccuagaagaccuaucuggguagugacgggaaaacuaacugaacuucuacgaagacauuggggcuuaaauagcuuauuaccagaugcucacagaggaaccgcuaaagccaaaaauagauuagaccauagacaccauaugauagaugcagcaguaguaggagcaaccgaucacgcaacaguacaaagaauagcaaauauggcaaaaggaaauguugaaaauggcuuagaagaccuagcuggaaccauacuaccaccauggccgggacuaagagaugaucuaaaagcuagacucgaaagaacaauagucucacauagaggcaaccacggagcaaucgacccugcagcucgaaaacaaggacgagauacgacaucaggacaacuacauaaugacacggcuuauggauuaacaggagaaacauuaaaaggagucccccuuguaguuaauagaaaaccaauagacauguuaacacccgccaugauagauaaaauuagagauccacauuuaagccgguggcuaacugcuguaacgaaaggcaaagaaggaaaagauuucaaagcugcgguagaagcauuucgagcccauccaggacccuauagaggaaucaggcguguaagauugauagaacccguagaaguaauuagaauaaaagauagaaaugggagaccguauaaaggguauaaaggcgacagcaaucaguguuaugaaguaugguguuuacccgauagaacauuaacacaccauguuguaaguacauuugcggcccaccaaggacaaacugggaaaccacacccagcagcuaaaagauuagcacgauuauauaaaggagacaugguaagacuagaucgcucaaaauucggaucagugauugcaacaguagaaaaauuugauagaaacggucagcuagagcuaguaccccacaaugaaggcaaugcagaucaacgauauagaaaagauaaaagugauucaguauucauuaggcuacgagcagccaccuucauagcgagcggugcaagacgcguaauaguugaugagauggggaggauacgggacccugguccagggaagcauuga

SEQ ID NO: 5018 - RNA, 3240 nt, Artificial Sequence
  Cas9 variant
augaaauacggaauaggacuggacugcgguauaaauucaguuggauacuguauaauggagcuuaacucugacgacgaaccuaaaagaaucguaagacuuaacucaagaaucuucacugaagcggaaaacccaaaagacgguuccaguuuagccgcaccaagaagagaagcaagaggauuaaggagaagaauccgaagacacaaacaccgccucgaaagaaucagagccuuauuagucagagaaaacauaguaacacaagcggaguuagacaauauguucucaggaacucuaucagacauuuaugaauuaagaacagcagccuuagacgcaccuuuaaacaacauugaauuugcacgcguacucauaaacuuagcucaacgaaggggauuuaaaagcaacagaaagucagaaaaaucauccagcgacaaagaaaccggcaaacuguuaagcgcuauaaaaaaaaauaaagagaguauagaagcaggaggauaccgcacaguaggagaaaugcucuuuaaagaugaaagauaugccaagcacaaaagaaauaaaggugaagcuuaccuaaacaccgugagccgagacaugaucgaggcagaaauccacgcagucuuugccucacagagaaauuuuggaaugccauuugcaaacgaaaaaaucgaaaacgaauauacagacaucgcauugucgcaaagaccuuucgaccugggcccaggagaaggacccgaaaauuguaaaucuccauacgcaggaaaacaaauaaaaaauaugauuggccaaugcaccuuuuuuccagaagaaaaaagagcaguaaaagccuccuacucauuccaacuguuuagucucuugcaaggaauaaauaauauaacucuugucuccucugacggaaauacuuucccacuaagucaagaacaaagaaaaacucuuaaagacuacugcuuuaaaacagcaaauguaacauaugcaaguauacgaaagguacugcaaauaccucaagaauacacuuucaaaaauauaacauacacagacgauggaaucgaaaaaagcgaaaaaaaaaccaaguuccaacaccucaaaccauaccaugaaaugaaaaagguacugggaucagcaauacaaacacucacaccagaagaacuugaugaaauuggagaaauauuuacguucuauaaagacgaaacaaucauaaucaaacaacuagaagaaacagaaauagacaaaucauuauaugauuuauuacuccaacuacccacauuugaaaaagcgggacacauaucuacaaaagccuguaagaugauaauaccauuuuuagaagaaggaaaaacauaugacaaagccugcgaaugcgcaggucucaacuucaaagcacacacaaauaugcagaaacaaaugcuucuaccugcaaaaucugacgaacuaaacgacguaguaaacccaguaguccgaagagcaaucagccaaacgaucaaaguaguuaaugcuauaauacgagagauggguacuucaccuacauacauaaacauagaauuagcaagagaacuuagcaaaucaaaaaaagaaagagaugaaauaaacaaaaaauauaaauugaaucaggcagaaaacgaacgauuaaagaaugaaauaauagacaacuucaaaauaaaaccaaacggacaagacauaauaaaacuaaaacuuuggcacgaacaggacgauggaauaugcccauacaccggcgucagaauaaaauaugaaaacuuauuugaugacggauacgcagaaauugaucauauaauaccguacuccuuaaguuuugacgacucauuuaauaacaaaauccuuacaacugcaacccaaaauagacaaaaaggcaaucgaauuccauuggaauaccuccccgaaucagaaaaagauggcuucagagucuggguuaacagcaacauacgcaaccauagaaaacgacaaaaccuucuaaaagaacacuuuacagaagcagauaaaaaagaauuuaaaagcagaaauuuaaaugauacccguuacuuaaacaaacuauuguuaaacuauaucaacgacaaccuauuauucacugauuucuauaacggaaaaaaaaagcauguaacaucaguuaacggggcaguaacagccuacaucaggaaaagauggggaauuaauaaaaauagagaagauggcgaccuacaucaugcaguagaugcagccguaaucgccuguguaacucaaggaauaauaaacagaauaacugcauauagcgcaagaaaugaagcaccauacgaucugaauaccgaaacuggugaaauaaaggagcgauuccccuuaccauaccccaauuucaaaaaggaacucgaugcuaggacaacuauugaagaugaaaaaagguuaaaaaggguucuaaugagcuuuucaaacuauucauaugacgacgucgaaaaggccaaaccguguuucgugucuagaaccccccauagaaaaguaacaggagcagcacacgaagaaaccauucgaagcggcaaagucgaaggauuuacuguaagcaaaacugaacugacuaaacuaaaguuaacaaauggagaaauugaaggauauuacgaaccagaaucugacacacuacuauacaaugcguuacuucaaagacuuaacgaauucggaggugaugcaaaagcggcauuugccgacgaauuccauaaaccaaaagcagacgggacucccggacccguaguaaaaaaaguaaagacaauaaaaagauccucgucuaacguuaaagcccgaaauaagaacggauuaggagucgcagacaauggcaguaugauaagaaucgauguauuuuauguagaaaaugaaggcuacuacuucgucccaaucuauguugcagacacaguaaaagagaugccaaaugaggcauguccuuucgguaaggauaaaaaaaaaauuaugacggacgacgacuuucuauucagcuuauauccaaaugaucuaauaaaaauuacagcuaaaaaagacaugaaguucagccuugcgaacaaagaauccggacugccaaaaaauaaauacgcuaaugaaguauuaguauauuacucagcagcagacauuagcaacgcaagcauuucugucauaaugcaugauaaugcauacaaauucagaggauguggaauuaaaucauuaguuaaacuagaaaaauacacgguggacccucucgguaacguaucuaaagucaauagggaaaaaaggauguauuuuaaauga

SEQ ID NO: 5019 - RNA, 3240 nt, Artificial Sequence
  Cas9 variant
augagacuaggccuugauauuggaaccucauccauaggauggugguuauaugaaacugauggggcuggaucggaugcaagaauaacaggcguagucgacggagguguaagaauauucucagauggaagggacccaaaaagcggcgcaucguuagcuguagauaggagagccgcaagagcaaugagaagaagaagggaucgauaucuacgacgccgugcaacauuaaugaaagugcuagcagaaacgggauuaaugccugcagacccugcagaagcaaaggcuuuagaagcacuagacccuuuugccuuaagagcugccggucuagaugaaccuuuaccacugccucauuuggguagggcacuauuucacuuaaaucaaaggcgaggcuuuaaaaguaaucgaaaaaccgacagaggugauaaugagagugggaaaauuaaggaugcaacugcuagacuagauauggaaaugauggcuaauggagcucggacauauggugaguuccuucacaaacgaagacaaaaagcaacagauccucgacaugucccuagcgucagaaccagauuaucaauagcuaaucggggaggcccggacggcaaggaagaagcaggauaugauuuuuauccagaucguagacacuuagaagaagaauuucauaaacuaugggcagcacaaggagcccaucauccagaauuaacagaaacgcuaagagacuugcuauuugagaaaaucuucuuucaaaggccacuaaaagaacccgaaguuggauuauguuuauuuucugggcaucauggaguaccacccaaagauccccgucugccaaaagcacacccucuaacucaaaggagaguccuuuacgaaacaguaaaucaauuaagaguuacagcugacggaagagaagcucgcccauuaacuagagaagaacgagaucaaguuauucaugcacuggauaacaaaaagccaacgaaaucucuuucgucaaugguacuaaaacuaccagcuuuagcaaaaguauuaaaacuacgagacggagaaagauuuacccuagaaacuggaguccgagacgcgauagcaugcgaucccuuacgugcaagcccggcccauccagauagguuugguccaagguggagcauuuuagaugcggacgcucaaugggaaguaauuaguagaauacgaagaguacaaucagaugcagaacaugcugcccuaguugacugguuaaccgaagcacacggauuagacagagcacacgcagaagcaacugcucacgcuccauuaccagauggauaugggagauuaggauuaacggcaacaaccagaaucuuauaucaacuaacugcagacguaguaacauaugccgacgccguaaaagcauguggcuggcaccauucagauggacgaacaggcgaauguuuugacagguuaccauacuacggugaaguauuagaaagacacgucauaccgggcucguaccauccugaugaugaugauauaacuagguuuggaagaauaaccaacccgacaguacauauaggacuaaaucaauugagaagacucgucaauagaauaaucgaaacacacggaaaaccacaccaaaucguaguagaauuagcaagagaccuaaagaaaucagaagaacaaaagagagcagauauaaaacgcauaagagacacuacagaagcagcaaagaaacgcagcgagaaacuagaggaauuagagauagaagauaacggccguaaucgaauguuauugagauuaugggaagaccuaaauccagacgaugcuaugaggagguuuugucccuacaccgguaccaggauaucagcagcaaugauauucgacgguucaugugauguagaccauauauuaccauacagcagaacgcucgaugauucuuuucccaauaggacacuuugccuuagagaagcaaauagacagaaaagaaaucaaaccccauggcaagcauggggugauacgccucauuggcacgcaauagcugcaaauuuaaagaaucuaccagagaacaaaagauggagauuugcaccagacgcaaugacccgguuugaaggggaaaauggauuuuuagauagggcauuaaaagauacucaauaucuugcaagaauaaguagaagcuaccuagauaccuuauuuacaaaagguggucaugugugggugguuccaggaagguuuaccgagaugcuuagaagacacuggggauuaaauaguuuauuaucagaugcgggucgaggggcuguaaaagccaaaaaucgcacugaucacagacaccaugccauagacgcagcagucauugcagcaacagauccaggacuauuaaacagaauaucaagagcagcaggucaaggugaagcagcaggacaaagcgcagaacuuaucgccagagauaccccacccccaugggagggauucagagaugaucucagaguaagauuagauagaauaauaguaagccaucgggcugaucaugggaggauagaucacgcagccagaaaacaaggacgcgauuccacagcgggacaacuucaccaagaaacggcauauaguauaguugaugacauacaugucgcaucaagaacagaucuccuaagucuaaaaccagcgcaauuauuggacgaaccaggaaggaguggacaaguacgcgacccucaacuacgaaaagcauuaagaguggccaccggagguaagacaggcaaggacuuugaaaaugcucugagauauuuugccagcaaacccggcccauaucaagcgauacgaagagugagaauaaucaagccauugcaagcacaagcaagaguaccaguucccgcacaagaucccaucaaagccuaucaaggugguucuaaucaucuuuucgaaauuuggaggcuaccagauggugaaauagaagcgcaaguaauaacaucguuugaagcacacacuuuagaaggagagaaaagaccacacccugcugcaaaaagauuacuaagaguucacaaaggugauauggucgcacuagaaagggacgggagaagaguagucggacacguacagaaaauggacauagcaaauggauuauuuauagucccacacaaugaagcgaaugcggauacccguaauaaugauaaaucagauccuuucaaauggauacaaauaggagcaaggcccgcaauugcaucaggcauaagaagaguaagugucgaugaaauaggaagauuaagagauggaggaacaagaccaaucuga

SEQ ID NO: 5020 - RNA, 3240 nt, Artificial Sequence
  Cas9 variant
auggacgaagaagcgaaaauacaauuaaguaaagaaucuuaugaagaagaacucgaaucuuuacuagagaaaaguggagaagaauuuagagauguguuccuacaagccaaaaagguauaugacgcaaucuuguuaagcgacauacuaagcacaaagaaacaaaauucaaaagcaaaauuauccuuaggaaugaucgaaagauaugacucacauaagaaagaucuagaggaacuaaaacaauuuguaaaagcaaaccuaccagagaaaacagccauauuuuucaaagacagcaguaaaaacggauaugcaggcuacauagacggaaagacgacucaagaagacuucuacaaauuucuaaagaaagaacuaaacggaaucgcuggcucagaacgcuuuauggaaaaaguugaccaagaaaacuuccuccucaaacaacgcacaacagcuaacggcguaauaccacaccaagugcauuuaacagaacucaaagccauaauugaaagacaaaaacccuacuacccauucuuagaagaggcacgggauaagaugauaagauuacuaacuuuuagaauaccauauuacguaggaccguuagcacaaggugaagaaacaaguucguucgcaugguuggaaaggaagacaccagagaaaguaacaccauggaacgcaaccgaaguaauagauuauagcgcaucugcaaugaaauucauacaaagaaugauaaacuaugacaccuaucuaccaacugaaaaaguccuaccaaaacauucuauauuguaccaaaaauauacaauauucaacgaacuaacaaaaguggcauacaaagacgaacgaggaauaaaacaccaauuuucgucaaaggaaaaacgagaaauauuuaaagagcuauuccaaaaacaacgaaaagugaccgucaagaaauuacaacaauuucuaagcgcgaacuauaacauagaagacgcggagauuuuaggcgucgacaaagcauucaacuccucauaugcaacauaucacgacuuccuagaccuagccaaacccaacacagaacgugucgcagaauuacuugaacaaccagagaugaaugcaauguucgaagacauaguuaaaauacucacaauauuugaagauagggaaaugaucagaacacaacucaagaaauaucaaagcguauuaggugauggauucuuuaagaaauuaguaaagaaacauuacacaggaugggguagauuaagugaaagauuaaucaacggcaucagagacaagaaaacuaacaaaacaauucuagauuaccuaauagacgacgacgacuucccauauaacagaaauagaaacuucaugcaacuaauaaacgacgauucacuaucauucaaagaagaauuagccaacgaacucgcauuggcaggcaaccaaaguuuacuagaaguaguagaagccuuaccagguucaccagccauaaagaaaggaauuuggcaaaccuugaaaauaguagaagaacucauagaaauaauaggauacaauccgaaaaauauaguaguagaaauggcacgugaaaaucagagaacuaacagaagcaaacccagacuaaaagcucucgaagaagcacucaaaucguuugauaguccccuccugaaagaacaaccagucgacaaccaagcccuacagaaagacagguuauaccuuuauuaucuacaaaacgggaaagauauguacacaggugaagcccuagauauagauagacuauccgaauacgacauagaccacauaauaccacgaaguuucauagucgauaacagcauagacaacaaaguucuaguaucaaguaaagaaaaucgauugaaaauggacgacguuccugaucaaaaagucgucauccgaaugcgaagauauugggaaaaacuguuaagagcaaaccuaaucagugaaagaaaauucgcuuaucuuacaaaacuugaguuaacaccugaagacaaagcacgauuuauucagagacagcuaguagaaaccagacaaaucacuaaacacguagccgccauauuagaccaauauuucaaucaaccagaagaauccaaaaacaaaggaauacggaucaucacucuaaagucaagccuaguaucacaauucagaaaaacauucggcauacauaaaguuagagaaauaaacaaucaucaccacgcacaugaugccuaccuaaauggcguaguugcaauagcguuacucaaaaaguacccaaaauuagaacccgaguucgucuauggaaauuacacaaaauuuaauuuggcaacagaaaacaaagcaacagccaagaaagaauuuuauucaaauauauuacgauuuuucgaaaaagaagaauacagcuaugacgagaauggagaaauauuuugggauaaggcaagacacauaccucaaaucaagaaaguaauaaguagccaccaaguuaauauagucaagaaaguagaaguccaaaccggaggauuuuauaaagaaacaguaaacccaaaagguaaaccagauaaacuaauucaaagaaaagcggguugggacgucagcaaauacggaggcuucgguucaccaguaguugccuacgcagucgcauuuauauaugaaaaagguaaagcacgaaagaaagcaaaagcaauagaagguauaacaauaaugaaacaaucauuauucgaacaagaccccauaggcuuuuuaucaaacaaaggcuauucaaacguuacaaaauuuauuaaauuauccaaauauacacucuaugaacuugaaaauggaagaagacguaugguagcaagccacaaagaggcccaaaaagccaauucauuuauacuuccagaaaagcuagugacuuuacuauucuacgcccaacacuacgaugaaauagcacacaaagaaaguuuugacuacgucaacgaccauuuaagcgaguuccgugaaaucuuagaccaaguaauagauuucagcaauagauacacgauagccgcgaaaaacacugagaaaaucgcagaauuauuugaacaaaaccaagaaucaaccguacaaucauugagucaaucauuuauaaaucucaugcaacuuaaugcaaugggagccccagcugauuucaaauucuucgacguaauaauacccagaaaaagauauccauccuuaacagaaauaugggaaucaacuauuauauaccaaaguauaaccggacugagggaaacucgcacaagaauggcgaccuuaugggauggugaacaauga

SEQ ID NO: 5021 - RNA, 3240 nt, Artificial Sequence
  Cas9 variant
auggacgaagaagccaaaauacaacuaucgaaagaaaguuacgaagaagaauuggaaucacugcucgaaaaaucaggugaagaguucagggauguuuucuuacaagcuaaaaagguguaugacgcaauauuauuaucagauauacuaucgacgaagaaacaaaauucaaaagcaaaacuaucauuagguaugaucgaaagauaugacucgcacaagaaagauuuagaagaacucaaacaauucgugaaagcaaaucugccagagaaaaccgcaauauuuuucaaagacuccaguaaaaauggauaugcaggauacauugacggaaaaacaacacaagaagacuuuuacaaguucuuaaagaaagaacuaaaugguauugcaggaucagaaagauucauggaaaaaguagaccaagaaaacuuuuuacuuaaacaacgaacaacagcaaauggaguuauuccacaucaaguacaucucacagaauugaaagcaauaaucgaaaggcaaaaaccguauuauccuucauuggaagaagccagagacaaaaugauacgccuacuaaccuuuagaauccccuauuacguaggaccauuagcacaaggagaagaaacaagcucauuugcaugguuagaacgaaaaacuccagaaaaaguaacaccuuggaaugcaacagaaguaauugacuacagugcuucugcaaugaaauucauacaaagaaugauuaauuaugacacauauuuaccaacugaaaaaguauuaccgaaacacucaauacucuaccaaaaauauacaauauucaacgaauugaccaaaguggcauauaaagacgaaagagguauuaaacaccaauuuucaucaaaagaaaaacgagaaauauuuaaagaauuauuucaaaaacaaagaaaaguaaccgucaaaaagcuacaacaauucuuaucagccaauuauaauauagaagaugcagaaauccucggaguagauaaagcauuuaacuccucauacgcaacuuaccacgacuuucuugaucucgccaaaccgaacaccgaaagaguagcugaacuucuggaacaaccagaaaugaacgcaauguucgaagacaucguaaaaauacucacaauuuucgaagaucgagaaaugauccgaacacaauuaaagaaauaucaauccguacuaggcgacggauucuucaaaaagcuagucaagaaacacuacacugguuggggaagauuaucagaacgacuaauaaauggaauaagagauaagaaaacaaacaaaacaauauuagauuaccuaauagacgaugacgacuucccauauaacagaaaccgaaauuucaugcaauuaauaaaugacgacucacucagcuuuaaagaagaauuagccaaugaacucgcgcuagcuggcaaccaaucauugcucgaaguaguagaagcacuacuagguucaccagccauuaagaaaggaauauggcaaacacuaaaaauaguagaagaacuaauagaaauaaucgguuacaaucccaaaaauaucguggucgaaauggcgagagaaaaccaaagaacaaauagaaguaaaccacggcuaaaagcacuagaagaagcacucaaauccuucgacucaccuuuacugaaagaacaaccaguugacaaccaagcacuacagaaagauaggcuauauuuauacuacuuacaaaacggaaaagauauguauacaggagaagcucuagacauagauagguuaucagaauacgauauagaccacauuauuccucggucauucauaguugacaacucaauugauaacaaagucuuaguaagcucaaaagaaaaccgacuaaaaauggacgauguuccagaucaaaaagugguaauuagaaugagaagauauugggaaaaacuccuacgagcuaaccuaauaucagaacgaaaauuugcauaucuaacaaaacuggaauuaaccccagaagacaaagcucgauucauacaaagacaacucguagaaacaagacaaauaacuaaacacgucgcagcaauacuagaucaauacuuuaaccaaccagaagaaaguaaaaacaaagguaucagaaucaucacgcucaaaucaucucuaguaucacaauuuagaaaaacuuucggcauaaacaaaguuagagaaaucaacaaccaucaccaugcccaugacgcauaucuaaacggaguaguagcgauagcauuacuaaagaaauaucccaaacuggaaccagaguucguauauggaaacuauacuaaauuuaaccucgccaccgaaaacaaagccacagcuaagaaagaguucuauucaaacaucuuacgauucuuugaaaaagaagaauacuccuaugaugaaaacggcgaaauauucugggacaaagcaagacauauaccccaaauaaagaaagucaucagcucacaccaagucaauauagugaagaaaguugaaguacagaccggcgguuucuacaaagaaacagucaaccccaaaggaaaaccggauaaacuaauacagcguaaagcagguugggacgucagcaaauacggaggcuuuggaagcccagucguugccuacgccguagcauuuauauacgaaaaaggaaaagcaagaaagaaagcaaaagcaauagaaggaauaacaauaaugaaacaaaguuuauucgaacaagaccccaucggauuccuuaguaauaaagguuacagcaacgucacaaaauucaucaaacugucaaaauacacauuauaugaacuagaaaauggaaggcgucgaaugguggcuucacauaaagaagcacaaaaagcuaacagcuucauacuacccgaaaaauuagucacuuuacuuuaccaugcacaacauuacgacgaaauagcccacaaagaauccuuugacuauguaaaugaccacuuaagcgaauuuagggaaauacuagaccaaguaauagacuuuagcaaccguuauacuaucgcagcgaaaaacacugagaaaaucgccgaacuauucgaacaaaaccaagaaucaacaguacaaucucuaucccagagcuucauuaauuuaaugcaacuuaacgcgaugggagcacccgccgacuuuaaauuuuucgacguaauaauaccccguaaaagguauccaagccuaacagaaaucugggaaagcacaauaauauaucaaucaauaaccggucugcgagaaaccagaacacggauggcaacacucugggacggagaacaauga

SEQ ID NO: 5022 - RNA, 3243 nt, Artificial Sequence
  Cas9 variant
augaaaacuagcuucgccuucgauauaggaacgaacagcauugguuggugcguauuggcuuuagacaaugcaaaccugccuuauagaauauuagaugcuggcguaagaauuuuuagcgacgggagggaaccaaaaucaggaacauccuuagcugaggguagaagauuagcucgcggaaugaguagaagacgugauagguacaaacgaagaagaaaagcagucauccguacacuaaucgaauauggacuaaugccagaugauccagcugcuagaagggcauuaguagcggaaaccaacgacaaagcuccaggcaaaaucgcaagcgacguguaugcauuaagagcuagagcuuuagaugauaaauugccauuacaucauauugguagagcucuauuucauauuaaccaacgaagaggauucaaaucaaacagaaaaacugauaaacgagauaacgaccaagguaaaauagcaucugguaucucccgacuuagagacaaacuagcaucagaaggaaugcguacacuaggagaauaucuaaaucauagacaucaagcaggaaauuggguuagaguaagaccaucaagaguaccugguaaagaugauaaagaagaagacgguuacggauuuuauccagaacgugcccuauugcaagaugaguucaaugcuauauggacagcccaagcagcgcacuauccugacguauuaacagaagaaagaagaacacaucuagaaacaauaauuuucuuucaaagaccucuaaaaccaguccaaguaggaaaaugcaguuuuaaucccggagaagaaagacucccacgagcacaucccuuauuccaagaauuucgacuuuauaaagaaguaaaugaacuagagcuaguugacagaaaucaagaucaccacaaauuaucgcuagaucaaagagacgcauuaauagcacaauugaaaacacaaagagaagccgccuauucagcgcuaagaaaaacggcgcgagcaccacuugggacgcgcuucaauaaagaaacugaaucccgaacgaaaaugaaaggagacgaagucgccgcagaacuaucugcaaaaaccagauucggacaggcuuggauaucgaugccucuggaagaaagauggauaauuguagauaccuugagacgaguagaagacccacuagagcuaacagcuuggcuagagcaacauuacggacuagacggagaacauauagaugcaauacuagcagcccggcucccagaaggauauggaagauuaggagaaacagcuuuaaccgaaauauuggucgaguuaaaggccgccguaauaagcgaagcagaagcugcuaggagagcaggauaugaucaugccuuauuacaaagaggagcuggacuagaagcauuaccaaaauaccaagaaguuauagcccgcaggaucccucccggaacagggaauccggaugaucccuaugacguugaaaaaggccggaucacuaauccaacuguucacaucggcuuaaaccaacuacaaaaagucuuaaaugcgcuuauacgucgauauggaaaaccugaacaaauugcaaucgaacuagcacgugaauuaaaauuaaacgacgaacagaaaagagaaaagaacauagaaauagccagaaauacuagagcagcggaacaacgcucagcaaaauuaguagaacuuggcgugccugauacaggauauaaucgugugcuucuaaaacuuugggaagaacuaaaccugcgagcaccagagaacagaguuugcaucuacugcggugaaccaauuaauaucgaaacacuauucucuagcgcaguagauauagaucauauacuacccuggucaaaaacacuggaugauucucaagccaauaggcuaguuugccacguggccuguaacaggcaaaaggcuaauuaugcgccagcagaaguaccacaauggcaaggaagauacgacgacauauuagcaagggcaaauacacuaccauugaauaaacgauggagauuuggaagagacgcgaugaaaaaguucgcagacgaagaaacauuucuagcuagacaacuaaccgauacacaauauuuaaguagauuagcucaugccuauauggcggcucuuuacccggaugaagaaccugaugcacaaggaguucuagcaaggaaaaaucacgucagaguuaucacagggcgaaugacagaaauguuacgaaggcaauggggucucaauucacuacuagcugaucauaaucagaaaaacaggaaugaccacagacaccacgcaauugaugcagcaguaguugggguaacaacacgagcucuuuuacaaaggauagccacaguggcagggggaagagaagcacaagcacuugaagaaaccauaggaaaaauugaacccccauggcccggcuuucgugaugagcuccaagcuguaauaaaacgaauuguaguaucacauaaaccagaucacgguacguugccaaaaccaggacaagguggacaaacagcuggucaacuacauaaugauacugcuuacgggcuaacaggcgaaaccgauucaagaggaacgccuauaguaguaagacgaaaacccuucacuucauuaaccgaaaaggacuuaccaucaauuagagauagacaauuagcccaggcacuagguucugcuauagcgggaaggucuggaaaagaguugcaagcagcacuugaacaauucagggauagagacgacuauaaaagcaucagacauguacguguaguagaaccucuaaacgucauaccaauaagggauggaacaggcagagcuuauaaagcguacaaaggagaugcuaauuacagauaugaugucugggaacuaccaaauggaaaauggaugcaugagguaguaaguauguucgacgcucaugauagaucguggacaagugcaguacacauacaucacccagcggcacgaagaguauugucacuaaaacaaaaugacaugguagcauaugaccauccgcaagacggaccaacaauagguagaguaguuaaauucucacaaagcggacaaaugacauuugccccucauaaagaagcuggagcucucaaagcacgagaugcugacccugaagauagauuccgauauuucuacaaaucagguucagcaaugaaagauauaggacuacgucaaguaagagucgacgaaauuggcagaguauuugaucccggaccaagagacaaagaagcgagaaacgcaagaaagaagaaaucgacagauuga

SEQ ID NO: 5023 - RNA, 3243 nt, Artificial Sequence
  Cas9 variant
auggcaaaaucuuucgcauucgauauggguaccaacaguauaggaugggcaguauuaggucuagauagcgcgggagauccagauucaauagaaggugcaggcguccguauuuuuagcgacggaagagaacccaagaguggagcuagcuuagcugaagguaggcgaaucgcaagaggaaugagcagacggcgagaaagauauaaagcacgacgaaaggcacuaauaaggacacuuggugauuauggauuaaugccccuagaaagggcugcuagacgagcguuaguggcagagaccaacgacagauccuuuggccuagucgcccaggauguauaugcgcuaagagcaagagccuuaguagaaaaacuaccacccuaucauuuggggcgagcacuguuccaccugaaucaaagacgagguuuuaaaucaaaucggaaaacagacggacgagauaaugaacuagguaugauagcaacuggaauagcugcauuagacgcacaauuaaacggccguacccuugggcaguaccuucaugaaaugaggggugcugauccuagacaaagggggcaagucagagucaggccacaucuagaaauaaaugauaaaggaagagaaauugcggcauacggauuuuauccucagcgcgcaauguuagaaagggaauuuaaugcaauaugggcagcacaagcaccacaucauccagaauuacucagcgaagaacggagagcacauuuauuucaagucaucuuuuaccaaagaccccugaagcaaccagauccaggaagguguuccuuuaauccagcagaaccccgccuggccaaagcccauccucuauuucaaagguuccgccuaguaaaagagauaaaugaacugagaauuguaacagguagcaauagucagggaguaccauuaacucuagaacaacgcgauauccuacuaacgcuacuaagagauaagaaagcaucuaguuuuaaaacauuauuagcaaaaauaauaaaaggacaaccagaagccagauucaacaaggcuucugacagcagagauaaaaugaaaggggaugaacuagcagcgacuaugagugacaaaacgagauucggacaagcaugguuugcaaugccugaagcagaacaauggaggaucauugcuaaauuaagagauauagacgaccccuuagaauuaaaugcaugguuagaaagcgaauauggacuagcuccggagagaagggaugcaguagcaaaugcauuacuaccucaaggauauggacgacuaggagaaacagccuuaagaacaauguuagauuaucuugaagccgcaguaauuagugaggcagaagcugcagcucaggccggcuacgaucaugcccuagcuagaagaggagcaggcuuagaucaacuacccaaauaucaagaaguauuaggacgccguauaccuccaggaaguggcgagccaaacgauccguacgacauaaggaugggacgcauuucuaacccaacuguucacauagcacuaaaccaauuaagaaggguaguaaaugcacuaauacgcaaguacgguaagccagcagaaauugcuauagaacuagcaagagauuuaaaacuaucagaggaacaaaagagagaaguaaaugcaacuaucgcaaagaacaccagagaugcggaaagacgagcaguaagauuagcagaugaagguauugauaauacagggcacaacagagcuuuauuacguuucugggaggaguuagcggcggacccacuagaucgaguuuguguauauugcgguggggguauaggagcggcaagucuauuuaacggaaguguagacaucgaucacauauuaccuuggucuagaaccuuagacgauagcagggcaaauagaauauugguucacaacagcuguaacaggcuuaaaagaaacuuugcgccauuugaaguaccggaauggcgagaaauauaucaagacauauuaguaagagcagcuaaacuaccagcaaauaaaaguuggagauuugcaccugacgcaauggaucgauucgaaggagagaaagauuuccuagccagacaauuaacagauacacaguaucuggcaagaauggcucacgaauauuuagcagccuuauauccggaugaggaaccugaugaauggggaguauucgcacgcggaaaucauguaagagugguaccagggagacuaacagaaaugcucaggagagcaugggguuuaaaugcaauccuuagugaugauaacagaaagaauagaaaugaccaccgacaucacgccauagaugcagucguuguaggagucaccacgagagacauguugaacaaaauaucacaagcagcaggaagaggagcagauaugggugcagcagaugcguugcgaagauuugauccuccauggccaucauuccaccaagccguaagagcagccgucgaaagaauauuagucagccaucgagcagaucaugggaccuuacccggaacugacggacaaggaaguacagcaggucaacuucauaaugauacagcauaugguuuaacaggggaaaccagaaaaggauuagcgguuguaguucguagaaaaccauauuuaucuuuagaaccgcgugauauagaaacuaucagagacccacaauuaagagaucaucuagccacagaaaccuaugggcucgcgggagccgaguucacggcagcgcuaaaaagauuacaacaaacagacaaauuuuaugcaggaauacgacgaguuagaguaacggaagcauuaaguguaauaccgauaagagaugcuacgggacacgcguauaaagcauacaaaggagaugcuaauuuucguuaugaugugugggaauuacccaauggaaaauggguuccugaaguuauaaguauguuugaugcgcaugauagaggaugggugucccaaguacaugcugcaaauccagccgcacgacgugucuuaagccucagacaaaaugacaugguugcuuaccagcacccggaacaaggccuaguauacggaagaguaguaaaauucgggcaaucaggccaaaugacuuucgcagcacaccacgaagggggaucuuuaaaaagucgcgacgccgauagagaugauccauuuaaauauuucuacaagucugcaggaacaaugaaagauauaggauuaagacagauaagaguagaugaaauagguagaguacaagauccaggaccucaagaucgagauucaaaaagaguacgaaaaagcgacagguga

SEQ ID NO: 5024 - RNA, 3246 nt, Artificial Sequence
  Cas9 variant
auggcugcguuuaaacccaaucccaucaacuauauauuaggacuagauauagguauagcaucuguaggaugggccaugguagaaauagacgaagaugaaaacccuaucugucuuauagaccuaggaguacguguauuugaaagagcagaaguaccaaaaacuggcgauagucuggcuauggcaagacgauuagccagaucaguaagaagauuaaccaggagacgagcacaucgacuacuacgugcuaggagguuacucaaaagagaaggcgugcuacaagcagccgauuuugaugaaaauggcuuaauaaaaaguuuaccaaauaccccauggcaacuccgagcagcagcgcuugauaggaaauuaacaccccuggaauggagcgcagugcuauuacaucucauaaaacaucguggauaccucagccaacguaaaaacgaaggggaaacugccgacaaagaauuaggugcauuacugaaagggguagcagauaaugcacacgcccugcaaacaggcgauuucagaacacccgcuaaauuagcacuaaacaaauuugaaaaagaaucaggucacauacgaaaccaaagaggagauuacagccauacuuucucacggaaagacuuacaagcugaacugaacuuacuauuugaaaaacaaaaagaauuuggcaacccucacauaagcgauggccugaaagaaggaaucgaaacgcuucuuaugacacagagaccagcauuaagcggagaugcuguacaaaagaugcucggucacugcacauuugagccaacagaacccaaagcagcuaaaaacacauacacugcagaaagguuuguauggcuuacaaaacucaacaauuuacggauauuagaacaagggucagaacaaccauuaacagauacacaaagggcaaaauugauggacgaacccuaccguaaaucaaaauuaacauaugcccaagcaagaaaacuacucggacucgaagauacggcauucuucaaaggacuacgcuauggaaaagauaaugcagaggcuucuacucuaauggaaaugaaagcguaucaugcaauuagcagagcucuagaaaaagaaggguuaaaagauaagaaaaguccccucaauuuaucaccugaauuacaagaugaaauagguacagccuuuaguuuguucaaaacagaugaagacauaacuggaagacuaaaagaccgaguacaaccagaaauauuagaagcauuauuaaaacauauuucuuucgacaaauucguacaaaucucuuuaaaagcacuaagaagaauaguaccacuaauggaacaagguaaacguuacaacgaagccugcgcagagaucuauggagaucauuacgggaagaaaaauacggaagagaaaauauauuuaccuccaauaccagcugaugaaauaagaaaucccguagucuuaagggcauuaagucaagcaagaaaaguaauaaauggaguagugaggcgauacgggaguccggcgaggauucauaucgaaacagcgagagaaguagguaaaaguuuuaaagaucggaaagaaauagaaaaacgacaagaagaaaacagaaaagacagagagaaagcagcagcaaaauuucaagaguauuuucccaauuucguaggcgaaccaaaaucaaaagacauuuuaaaacuuagacuauaugaacaacaacaugggaaaugucuauauucgggaaaagaaauaaauuuaggaagauuaaaugaaaaaggcuauguagaaauagaccaugcauuaccauuuuccagaacaugggaugacucguucaauaauaaaguucuuguucuggguucagaaaaucaaaacaaaggaaaucaaacaccguaugaauauuuuaacggaaaagauaacagucgugaauggcaagaguuuaaagcuaggguugaaaccagcagauuuccaaggaguaaaaagcaaaggauuuuauuacaaaaauuugaugaggauggauuuaaagaaagaaaucuuaaugacacgagguauguaaaccgauucuuaugucaauuuguagcagaucgaaugagacuaacuggaaaagguaagaaacgaguguuugcauccaauggacaaauuacaaacuugcuaagaggcuucugggguuuaagaaaaguuagagcugagaacgacaggcaccaugcucuagacgcagucguaguagcauguuccacagucgcuaugcaacagaaaauaacccguuuuguucgguacaaagaaaugaacgcauucgauggaaaaacaauagauaaagaaaccggagaaguacuucaccaaaagacucauuucccacaaccaugggaauuuuucgcacaagaagugaugauaaggguuuucggaaaaccagauggaaaaccugaguucgaagaagcugauacacccgaaaagcuaagaacguuauuagcggaaaaauuaucuagcagaccugaagcaguccacgaauauguuacuccucuauucgucucuagagcaccaaauaggaaaaugaguggacaaggacacauggaaacgguaaaaagugcuaaacgauuagacgaaggagugucaguacuaagggugccauugacacaauuaaaauuaaaagauuuagagaaaaugguaaauagggaaagggaaccaaaauuauacgaagcacuaaaagcacggcuagaagcacauaaggaugauccagcaaaagcguucgccgaacccuucuacaaauaugauaaagcaggaaacagaacacaacaaguuaaagcggugcgaguagaacaaguucagaaaacaggaguauggguuagaaaucauaacggaauagccgauaacgcaacaaugguaagaguugauguuuucgaaaaaggagauaaauauuaccuaguuccaauauauucauggcaaguugcaaaaggcauacuaccagacagggcaguuguagccuacgcagacgaagaagauuggacaguaauagaugaaucauuuagauucaaauuuguacuauacucuaaugaucuaauaaaaguucaacuaaagaaggacagcuuuuuaggauauuucucagguuuagacagagccacaggggcaauaucauuaagagaacacgacuuagaaaaaucgaaaggaaaagauggaaugcauagaauugguguaaaaacagcuuuaucauuucaaaaguaucaaauagaugaaauggguaaggaaauccgaccaugucgauuaaagaaacgaccacccguucgcuga

SEQ ID NO: 5025 - RNA, 3246 nt, Artificial Sequence
  Cas9 variant
auggcggcauuuaaaccaaacccaauaaauuauauccuaggacuagauauaggaauagcaucaguaggaugggcaaugguagaaauagaugaagacgaaaauccgauaugucugauagauuuaggagucagaguuuuugaaagagcagaaguaccaaaaacaggugauucucuagcugcagcccgaagacuggcucguucaguaagaagacuuacaaggagaagggcucauagguugcucagagcuagaagguuacuaaaacgagaaggagucuuacaagcugcagauuuugaugaaaauggacuaauaaagagcuuaccaaauaccccauggcaauuacgaucggcagcacuagauagaaaauuaaccccuuuagaauggucagcuguacuacuacaccuaauuaaacaucgaggauaucuaagucaaaggaaaaaugaaggugaaacugcagauaaagaacuuggcgcauuauuaaaaggcguugcagauaaugcucacgcacuccaaacuggagauuuucgaacaccagcggaauuggcucuaaacaaauuugaaaaagaaucaggacauauuagaaauagacgcggagauuacucacacaccuuuuccagaaaagaccuacaagcagaacuugaccuauuauucgaaaagcagaaagaguucgguaauccacauauaagcgacgaucuaaaagaaggaauagaaacuuuguuaaugacgcaacgaccagccuuaucuggugaugcaguacagaaaauguuaggucacuguacauuugaaccaacagaaccaaaagcagcuaaaaauacuuacaccgcagaaagauuuguaugguuaacuaagcuaaauaaccuaaggauauuagaacaaggaagcgaaagaccauuaaccgacacagaaagagcaacccucauggacgaacccuaucguaaaucaaaacugacauaugcacaagcaagaaaacuuuuagaacuagacgauacugcauucuuuaaaggauuaagauauggaaaagacaaugcagaagcaaguacguuaauggaaaugaaagcauaccacgcaauaaguagagcuuuagaaaaagaaggauugaaagauaagaaaagcccacuaaaccuaaguccagaauuacaagaugaaauaggaacggcguuuucacuauuuaaaaccgaugaagauauuacagggcgucuaaaagacaggguacagccagaaaucuuagaaguauuauuaaaacacauuaguuuugauaaauuuguacaaauaucacugaaagcauugagaaggauagucccauuaauggaacaaggaaaaagauaugacgaagcaugcgcagaaauuuacggagaucacgacggaaagaaaaauacagaagagaaaauauaccuaccaccgauucccgcugaugaaauaagaaacccaguaguauuaagagcauugucacaagcacgaaaaguuauaaacgcaguaguaagaagauaugguucaccagcaagaauacacauagaaacagcuagggaagugggaaaaaguuuuaaagauagaaaagaaauagagaaaagacaagaagaaaauagaaaagauagggaaaaagcagcagcgaaauuccgagaauacuuuccuaacuuuguaggagaaccaaaguccaaggacauucuaaaauuaagacuguacgaacaacaacauggaaaaugucuauacucaggaaaagaaauaaacuuaggaagauuaaaugaaaaaggcuauguagaaauagaucacgcauuaccauucagucgaacuugggacgacuccuucaacaauaaagugcugguccucggaagugaaaaucaaaacaaagguaaucaaacuccauaugaauauuuuaacggaaaagauaacucucgagaauggcaagaguucaaagcacgaguagaaacuagccgauuccccagaucaaagaaacaacguauauuauuacaaaaauuugaugaagaaggauuuaaagaacgaaauuuaaacgauacuagguaugucaauagauucuugugucaguucguagcagaucauauguuguuaacugguaaagguaaaagacguguauucgccucuaacggccaaauaacaaacuuguuaaggggauuuuggggauuaagaaagguuagagccgaaaacaaccgccaucaugcacuagacgccgugguaguagcaugcucaacaguugcaaugcaacagaaaauaacacgcuucguaagguauaaagaaaugaacgcguucgaugggaaaacaauugauaaagaaacgggagaaguacuacaccagaaaacucauuuuccacaaccaugggaauuuuucgcucaagaagugaugauuagaguauuugguaaacccgacgggaaaccugaguucgaagaagcagacacccccgaaaaauuaagaacgcuauuagcggaaaaauugucaucgagaccagaagcaguacaugaguauguaacaccuuuauuugucuccagggcaccaaaccgaaaaaugaguggucaaggacauauggaaacgguaaagagcgcaaaacgacuagacgaaggugugucaguccuccgagucccacugacacaauuaaaauuaaaagacuuagagaaaaugguuaauagagaaagggaaccaaaguuauaugaagcacuaaaggcacguuuagaagcacauaaagaugauccagcaaaagccuucgcagaacccuucuauaaauaugacaaagccgggaauaggacacaacagguaaaagcuguaagaguagaacaaguccagaaaacuggcguaugggugcgaaaucacaauggaaucgcagauaaugcaacgaugguccguguugauguuuuugaaaaagcuggaaaauauuacuuaguuccaauauacucguggcaaguagcgaaaggcauucuaccagaccgagcuguuguagcuuacgcggacgaagagggguggacaguaauagaugagagcuuuagauucaaguucguguuauauaguaaugauuuaauaaaaguccaacuaaagaaagacaguuuucuagguuauuuuucaggucuagaucgagccacaggcgcaauuagucuucgagaacacgacuuagagaaaaguaaagggaaagauggcaugcacagaauuggugucaaaacagcacuaucauuucaaaaauaucaaauagaugaaaugggaaaagaaauacgucuaugccgauuaaagaaaagacccccaguaagauga

SEQ ID NO: 5026 - RNA, 3246 nt, Artificial Sequence
  Cas9 variant
augaccgcauucaaaccuaaucccauuaauuacauacugggcuuagacauagguauagccucaguagguugggcaaugguugaaauugaugaagaagaaaacccgauuaggcuuauagacuuaggaguaagaguauucgaacgagccgaagucccaaaaacaggagacagucuagccgcagccagacgacuagcaagaagcgucagaagguugacaagacgcagagcucacagacuauuaagagccaggagauuguuaaaaagggaaggcguucuccaagcagcugacuucgacgaaaaugguuuaauuaaaucucuuccuaauacaccuuggcaacuaagagccgcugcauuggauagaaaacucacuccucuugaauggagugcuguccuguuacaucuaauaaaacaucgagguuacuuaagccaaagaaaaaaugaaggagaaacggcagauaaagaacuaggcgcgcuucuuaaaggaguagcagauaaugcccaugcgcuacaaacaggagauuucagaacgccugccgaacuagcagucaacaaauuugaaaaagaaucuggccauauuagaaaccaaagaggcgauuacucccacacauuuucgcgaaaagauuuacaagcagaauuaguauuauuauuugaaaaacaaaaagaauuuggcaacccacauauaucugacggccugaaagaaggaauagaaacacucuuaauggcacaacgaccagcacuaagcggagaugcgguccaaaaaauguuagguuacuguaccuucgaacccacagaacccaaagcggcaaaaaauaccuauacugccgaaagauuuauaugguugacgaagcuaaauaaccuacgaauccuagaacaagguucagaaagaccacuuacagauacagaacgagcaacauuaauagauaugccauacaaaaauaaauuaacuuacgcaaaagcacgugaacuacuagguuuagaugacacagcuuuuuucaaaggucuucgguauggcaaagauaacgcagaaagcgcuacccucauggaaaugaaagcauaucacgcaauaagacgugcacuagaaaaagaaggucuaaaagauaaaaaaaguccauuaucucuaucaccagaacuacaagaugagaucggaacagcauuuagcuuauuuaaaacggacgaagacauaacgggaagauuaaaaggauguuuacaaccagagauucuagacgcauuacuuaaacauauaaauuuugacaaauucguucaaauuucacuaaaagcauuaagacgaauaguaccauuaauggaacagggaaaaagguaugacgaagcaugcgcugaaaccuauggggaccacuacggugaaaaaaauucagaagagaugcuauacuuaccacccauaccagcagaugaaaucagaaacccaguagucuuacgagcauuaucucaagcaagaaaaguaauuaauggagugguacgaagauacggaucaccagcaagaauucauauugaaacagcacgcgaaguagguaaaaguuucaaagauagaaaagaaauagaaaaaagacaagaagaaaauagaaaagauagggaaaaagcagcggcaaaauuuagggaauauuucccgaauuucgucggugaaccaaaaucaaaagauauauuaaaacuuagauuauacgagcaacaacacggcaaauguuuauacucaggcaaagcaaucgauauuagacgauuaaacggaaaaggauauguagaaauagaucaugcccuuccuuuuucuagaacgugggaugauucuuuuaauaauaaaguacucguucuaggaucugaaaaccaaaacaaaggaaacagaacaccauacgaauaucuuaacggaaaagacaacucaagagaaugguuagaauuuaaagcaagaguugaaacuagcagauuuccucauaguaaaaaacaaagaguuuuacuacaaaaauucgacgaaaaagguuuuaaagaaaggaaucucaaugacaccagauacgugaacagguuuuuaugccaauuuguagcugaccauaugcaacuaacagguaaagggaaacgaagaguguucgcuaguaacggacaaauaacaaaucuauuaagaggcuucuggggacugcauaagguaagagcggaaaacgacagacaucaugcuuuagacgcaguaguaguagcaugcucuacaguagccaugcaacaaaaaauaacauguuuugugagauauaaagaaaugaacgcauucgauggaaaaacuguagacaaggaaacaggugaaguauugcaucaaaagacccacuucccacaaccuugggaauucuucgcacaagaagucaugauaagagucuuuggaaaaccagauggaaaaccggaauucgaagaagcagauacacccgaaaaacuuagagcgcuacuagcagaaaaacuaucaagcagaccagaggcuguacaugaauacguuacgccacuauucguaucaagagcaccaaauagaaaaaugucuggagcucauaaagauacgcuacguucagcaaaaagguucguaaagcauaaugaaaaaauaaguguaaaacgggucuggcuuacagaaauaaaauuagcagaucuagaaaauaugguaaauuacaaaaauggacgagagauagaauuauaugaagcccucaaagcaaggcuaggggcauacggaggaaaugccaaacaagccuucgauccgaaagauaacccuuucuacaaaaaaggaggccaacuaguuaaagcgguaagaguagaaaaaacacaagaaucuggcguauuacuaaauaagaaaaacgcauacacaauugcagacaacggagacaugguaagagucgacgucuuuugcaaaguagauaaaaaaggaaaaaaucaauauuuuauuguaccgauauaugcauggcaaguagcagaaaacaucuuaccugacauugauugcaaagguuaucgaauagaugauaguuauacauuuuguuucagucugcauaaauaugaucuaauagcuuuucagaaagaugaaaaaucuaaaguagaauuugcguauuauauaaauugugauuccucaaacggacguuucuauuuagcauggcaugacaaaggaucaaaagaacaacaauucagaauaagcacacaaaaucuaguauuaaugcaaaaauaccaaauagaugaguuaggaaaagaaaucagaccaugucgacucaaaaaaagaccaccggucagauga

SEQ ID NO: 5027 - RNA, 3246 nt, Artificial Sequence
  Cas9 variant
auggcggcguucaaaccaaaccccauaaacuacauauuaggacucgauaucggcauugcaagcgucggaugggcaauggucgaaauagaugaagacgaaaauccaauaugucuuaucgaucuuggaguacguguauuugaacgugcugaaguaccuaaaaccggagacaguuuggcagcggcucggcguuuagcuaggucgguaagaagacuaacacgaagaagggcacaucgucuacuaagggcaagaagacuacucaaaagagaaggcguacuucaagcagcugauuucgacgaaaacggauuaauaaaaucucucccaaacacaccauggcaauuaaggagugcggcuuuagauagaaaauuaaccccacuggaauggagugcuguacucuuacaccugauaaaacauagaggauaucuuagccaacgcaaaaaugaaggugagacagcugacaaggaauugggcgccuuguuaaaagggguagcuaacaacgcgcacgcauuacaaacaggcgauuucaggacuccagcugaauuagcguuaaacaaauucgaaaaagaaaguggacauauaaggaaucaaaggggcgauuauucucacacuuuuaguagaaaagacuuacaagccgagcuaaucuuauuauucgaaaaacaaaaagaguucggaaacccccauguuuccgggggucuaaaagaaggaauagaaacuuuacuaaugacacaaagaccugcacuuucgggcgaugcaguucaaaagaugcucggacacugcacauuugaaccagcagaaccaaaagcugcuaaaaauacauacaccgccgaaagauuuauauggcucacuaaauuaaauaacuuacgcauuuuagaacaaggaagugaaaggccacuaacagauacagaacgcgcaaccuuaauggaugaaccauaucgcaaauccaaacuaacauacgcacaggcucgcaaauuacuaggccuagaagauacagcuuucuuuaaaggacugagguacggaaaagacaaugcagaggcuucaacucuuauggaaaugaaagcauaucacgcgaucucaagagcucucgaaaaagaaggacuuaaagauaagaaaagucccuuaaauuuaucaccagaacuacaagaugaaauuggaacagccuuuucauuauucaaaaccgaugaagauauaacaggaagauuaaaagauagaauacaaccagaaauucucgaagccuuauuaaaacauaucuccuucgauaaauuuguucaaauaucgcuaaaagcacuucgacgaauaguaccacuaauggaacaggggaaaagauaugaugaggcuugcgcagaaauauauggagaucauuacggaaagaaaaacaccgaagagaaaauauacuuaccuccaaucccagcugaugaaauccgaaaccccgucguacugagagcuuuaagucaagcaagaaagguaauuaauggcguaguaagaagauauggaagccccgcaagaauacauauagaaacagcgagagaagucggaaaaaguuucaaagacagaaaagaaauugaaaagaggcaagaagaaaauagaaaggacagggaaaaagcagcagccaaauuuagagaauauuuuccaaauuuuguaggagaaccaaaaagcaaggacaucuuaaaacuacgauuguaugaacaacaacauggcaaauguuuauauucaggcaaagaaauaaaccuagguagauuaaacgaaaaaggguauguagagauagaucaugcauuacccuucuccaggacaugggaugauaguuucaauaauaaaguauuaguacuaggaagcgaaaaucagaacaaagguaaucaaacaccuuaugaauacuucaacgguaaagacaacucacgagaauggcaagaauuuaaagcacguguagaaacuagcagauuuccgcgaucuaagaaacaaagaauauuauugcaaaaauucgacgaagacggauuuaaagaaagaaaucuaaacgauacaagguauguaaaccgauuccuaugucaauucguugcagauagaaugagacuuacaggcaaaggaaagaaacgaguguuugcaucuaauggacaaaucacaaaucucuuaagaggauuuuggggacuaaggaaaguacgcgcagagaaugauagacaccaugcauuagacgcaguaguagucgcaugcuccacaguagcaaugcaacagaaaauaacaagauucguuagauacaaagaaaugaaugccuuugaugguaaaacaauugauaaagaaacgggagaaguauuacaccagaaaacgcacuuuccacaacccugggaguucuucgcccaagaaguaaugauacgagucuucggaaaaccugauggaaaacccgaauuugaagaagcugauacaccagaaaaauuaagaacacuguuagcugaaaaauuaucaagcagaccagaagcaguacacgaauaugucacuccccucuucgucaguagagcgccuaacagaaaaaugaguggacaaggacacauggaaacuguuaaaagugccaaacgucuagaugaaggaguaucaguuuuaagaguaccacuaacacaacucaaacuaaaagaucucgagaaaaugguaaacagagaaagagaaccuaaacuuuaugaggcacucaaagccagacucgaagcacauaaagacgauccagcaaaagcauucgcagaaccauucuauaaauaugauaaagcugguaacaggacccaacaagugaaagccguacgaguugaacaaguccagaaaacaggaguuuggguaagaaaccauaauggaauagcugacaaugcaacgauggucagaguagacgucuuugagaaagcaggaaaguauuaccuaguaccaauauauuccuggcaaguagcuaaaggaauauuaccagauagagccguaguagcauaugcagaugaggaagguuggacagucauagacgaaucauuuagauucaaauuuguguuauacaguaaugauuuaaucaaaguacaacucaagaaagauucauuccucgguuauuucucagggcuagauagagcgacaggggcaaucucacuaagggaacaugauuuagaaaaaucaaaaggaaaagacggcaugcauagaaucggaguuaagacugcacuauccuuccaaaaauaccaaaucgacgaaaugggaaaagaaauacguuuaugcagauuaaagaaaaggccacccguacguuga

SEQ ID NO: 5028 - RNA, 3246 nt, Artificial Sequence
  Cas9 variant
augcuaaaaagaguuuuaggaauagaugucggaauauccagcauaggaugggcacuccucgaauuucaaggagacauagacaacaaagaucuaccuuccggaaaaaucuuggcaucagggguaagaguuuuuacucaagcagaaaacccgaaaaacggcgagucacuugcgaaaccacgacgagaugcaagauuggcacgaagaagaaccagaagacgagcacagaggcuaacagauauaaaagauuuauucuucaaauauaaacucgucaccgggauaagcagaaauaaaauuaauaguauauacaaaaccgaagaaaauaaaaaagacccuuggacuuuaagaaaagaagcuuuauacagaaaacuagacggagaagaguuugcaagaguguuaacucacauagcaaaacacagaggguucaagucuaugagaaaaagcgaagaagaaggcagcgacacaaaagcuaaagaaacgcaaagaguuuuaacagaaauaggaaaaaacaaagacacacuaaagacaggcauauggcaaacagccggagagaugauugcaagcaggccaaaaggagacgccagacgaaacaaaacugacucauauaaaaauagcauaucgagggagcuacuacaagaugagacaaagauaauauucgaaaaacaaagaggaaugaauucacaauucacgucagcagaucuagaaaaagaauacagcgauauagccuuccaccaagcaccaauacaaucaaugcucaaaauggucgggggauguacuuuugaaaaggaugaagaagguaaacgauuaaaacgagccccaaaaaacucauauuccgcagaaguuuucaccgcuuuaacuaaaauaaauaaccuaguacuuaaaacuaaaacugccaacaucaacgaccgcuuccuuacuacagaggaaagaaaaaaggcacuagaacugugccauucaaaugcaaaaguaacauucaaacagcuuagaggugaauuagggcuaccagaagacuggaucuucaacacaguagacuaugcaaagaaaccgaaaaaaaccgccgucaaagaaaccgaacccgaaucugcuugcuucuuccagaugagaggauauaaugaaauaagaaaaagcgugggaaaggacuuguggaccgaaauaagcaugaaaaaagaaauacuaaauaguauaguuacaacacuagcaacagaaaaaagugacgaagccaucaaggcucaauuaaaaaaaagugaagucccggaugaaauugccgaaaaaguacuaggacuuaacuucagagguuuucugcaccuaaguauaaaagcucuggacaagauaauuccguucaugauggcaggugacaaauacacagacgcaugugauaaagcagguuacaaggaacaaauuaguggcauaaagaaaauauuucucagaaaacuaaacgaugaagaaaacgaacaaauaacaaaccccguagccaagagagcuaucacacaguuuagaaaaguaauuaacgcgauaauaagagaauacgggaaauuugaccaaaugaauauagaauuagcuagagaucuagcaaaaucauacgacgacaggaaaaaaaucaaagaaggacaagaagauuucagagcugaaaaagaccgagccgcccaaagguguaaagauaauggcuuagauccaaauaguaaagacaacuuaaguaaauaccggcuaugggaacagcaggacaacggauucuguauuuacuguggcaaaccaauagaacuacagagacuggcugaacaagguuacugugaaguagaucauauacuacccuacagccgaagcuuagaugacucacaacacaacaaaguacuagcccacauacaugauaaucaacaaaaaaaaaaucaaaucccuuuugaacacuuuggaggagauggaccaaaaugggaagaauucguaggaagacuaaacagucaauucaaaaacuuaccaaaaucaaaacuaaauagauuagugaaaagaaaauucgacgaaaaagacauggaaggcuucaaagaaagaaacaucaaugacacacgauauauaucaagauucauaaaaaauuuugucgagaaccacuuagaauucgcugaaagcgcacaaaaacaaaaaguauucguacgaagcgggucuuuaacagcauuucugagacaucaaugggguuugauaaaaaaaagagacgaaucagaucgccaccacgcacuagaugcacucguaacugcaugugcaacacaagccaugguaaaaucuacugcaauaacagcucaaaaaauggaaaguuauaauuggauaaauaaagaaaaaccuagaaugccacuaccauggcugaacuuucgagacgacguacaaaaaagccuggaugccguauucguaagccgagcuccacgacacaaaguaggaggcgcugcacacaaagaaaccauaagauccauaagaaaaugcggcgaagaaaaucuaauaaucgaaaaaacccccuuaguagauauugcaacgaaaucaggaaucaaacucaaagacauugaaaaacuauauaaaaaagaacagaauagaaaacucuacgaaacauuaaaggaaagauuagagcaaaauggaaacgacccuguuaaagcauuuggaaaccccgaugacccaguucguaugccaaccaaugaucuaacaaaaacgggaccaauuauaaaaucaauaaaacuaauaacgaauaaaaaaagcggauuaaacguaagagcaggaauagcugacaauggcgaaauagcaaggcuagacguuuacgaaagaaaaggaaaguucuaccucauaccgaauuauguagcugauuucgcaaacaaagaauuaccuaaaaaggccaucaaagcgaauacaccagaaacagaauggccaauaauagacagaaacuacaauuuuaaauucucgcuguucaaagaugaucugauaaguauaaaacaaaaauuagacaguccagaagaguucuauuauuauaaaggacccgacgugucaacggcaucuauaacuguagaaagcgucgauagaaaacggcuaugggaagaaaaaaaaaaaggaaaaauugaaaacgucuuucauacccgaaucgggacaaagacacuaaaaaguuuuagaaaauuuaacuuagauauauuaggcacuaaagcaccaguagaaaucaaaaaagaaacauggguuggaguaauacggaaaaacggagucgcaaacaacacagguaacaaagcaauguga

SEQ ID NO: 5029 - RNA, 3249 nt, Artificial Sequence
  Cas9 variant
auggccgccuuuaaaccaaauccgaugaacuauauauuaggacuugauauaggaauagcgaguguaggaugggcuaugguugaaauagacaaagaagaaaacccaauaagauuaauagaucuaggagugcgcguuuuugaaagggcggaaguaccaaaaacaggagauucacuugcaauggccaggagacuugcaagaaguguaagaagacuaacuagaaggcgagcucauagacuacuuagggcaagaagauuacuuaaaagagaagggguauuacaagaugcagauuuugacgaaaacggacucgugaaaagucuaccgaauacuccauggcaauuaagagcugccgcauuagaucgaaaacucacuuguuuagaauggagugccguacuacuacaucuaauaaaacacagaggcuacuuaagucaaaggaaaaaugaaggagaaacugcagauaaagaauuaggugcgcuauugaaaggcgucgcugauaaugcacaugcccugcaaacuggagacuuuagaacacccgcagaacuagcacuuaacaaauucgaaaaagagaguggucauaucagaaaccaaagaggagacuauucacacacuuucucaagaaaagacuuacaagcagaacuaaauuuauuauucgaaaaacaaaaagaauuuaguaauccacauguaucagauucacuaaaagaaggaauagaaacacuauuaauggcacaacgcccagcguuaagcggggaugcgguacagaaaaugcuaggucauugcacauuugaaccagcagagccaaaggcagccaaaaauacauauacugcagaaagauucauaugguuaacuaaacuaaauaacuuaagaauuuuggagcagggauccgaaaggccauuaacagacacggaaagagcaacauuaauggaugaaccauaucguaaaagcaaauuaacauaugcacaagcaagaaaacuauuaggauuagaagacacagcauuuuucaaagguuuaagguacgguaaagauaacgcagaagcaccaacauuaauggaaaugaaagccuaccacgcgaucucaagggcauuagaaaaagaaggccucaaagauaagaaaucuccauuaaaucugucaacagaacuacaagaugaaauagguacagcauucuccuuguuuaaaacagauaaagacauaacaggacgacuaaaagacagaguacaaccagaaauacuagaagcccuacuaaaacauauaucauucgacaaauuuguacagauuucuuugaaagcacucagacguaucguaccucuaauggaacaaggaaaaagauacgaugaagccugugccgaaauauauggagaucacuauugcaagaagaaugcagaggagaaaauauauuuaccuccaauaccugcagaugaaauuaggaacccagucguacuaagagcgcugagucaggcuaggaaaguaauaaauugcguaguacgaagauauggauccccagcuagaauccacauagaaacggcccgugaaguagguaaaaguuuuaaagaccgaaaagaaauagagaaaagacaggaagaaaaccgcaaagaccgggaaaaagcagccgcgaaauuucgagaauauuuuccgaacuuuguaggagaaccaaaaaguaaagauauauuaaaacuucguuuguacgaacaacaacauggcaaaugucuauauucagguaaagaaaucaaccuuguccgauuaaaugaaaaagguuacguagaaauagaccacgcacuaccauucaguagaaccugggacgacaguuucaacaauaaaguacucgucuuaggaucagaaaaucaaaauaaagguaaucaaacaccuuacgaauacuucaacgggaaagauaauucacgagaauggcaagaguucaaagcaagaguugaaacuucacgauuuccgcgaucaaagaaacagaggauauuauuacaaaaauucgaugaagaaggauucaaagaacgcaacuuaaacgauaccagauauguuaauagauuucuuugucaauucguggcagaccauauucuauuaacuggcaaggguaaacgaaggguuuucgcaaguaauggccaaauaacgaaucuacuuagaggcuuuugggguuuaagaaaaguaagggcugaaaacgacagacaucaugcccuagaugccguuguaguagcuuguaguacgguggcaaugcaacagaaaauaacuagauuuguucguuauaaggaaaugaaugcuuucgauggaaaaacaauagacaaagaaacaggagaaguguuacaucaaaaagcacacuuuccacaaccgugggaguucuuugcacaggaaguaaugauccggguauuuggaaagcccgauggaaagccagaauuugaagaagcagauacaccagaaaaauuaagaacauuauuggcagaaaaacuaucaaguagacccgaagcgguccacgaguacguaacaccauuauucgugucaagagccccaaauagaaaaaugagcggacaagggcauauggaaacaguaaaaagugcgaagagguuagacgaagguauaagcguucuuagaguccccuuaacacaacuaaaacuaaagggacuugaaaagaugguaaaccgagaaagagaaccaaaacuauaugacgcacuaaaagcccaauuagagacacacaaagauaaccccgcuaaggcuuuugcagaaccuuuuuauaaauacgauaaagcuggcaauaggacacaacagguaaaagcgguuagaauagaacaaguccagaaaaccgguguauggguucgcaaucauaauggcauugcagacaacgcuaccaugguacggguagacguuuucgaaaaagggggcaaauauuaccuaguaccaauauauagcuggcaaguagcuaaaggaauauuaccagaucgagcaguugucgcauuuaaagacgaagaagacuggaccguaauggacgauucguucgaguucagauuuguucuauaugcaaaugacuuaaucaaauuaacagcaaagaaaaacgaauuucucgguuacuucguaucauuaaacagagcaaccggagcuauagauauacgaacacaugauacagacaguacaaaagguaaaaauggaaucuuccaauccguaggcguaaaaacagcacucucauuccagaaaaaucaaauugaugaauugggaaaagaaauuagaccauguagauuaaagaaacgacccccaguaagauga

SEQ ID NO: 5030 - RNA, 3249 nt, Artificial Sequence
  Cas9 variant
auggcagcuuucaagccuaacccaauuaacuauauauuagggcuugauauaggaaucgcaaguguagguugggcaaugguagaaauagaugaagaagaaaauccaaucagauuaaucgaucuagguguaagaguauucgaacgugcggaggugccuaaaacuggagauagucuugcuauggcacgacgucuagcaagaucaguacgaaggcucacacgaaggagagcucauagacucuuaagagcgagaagacuauuaaaacgagaaggcguucugcaagcagcagacuuugaugaaaauggccuuauaaaaagccuacccaauaccccguggcaacugagagcagcggcccuagacagaaaacuuacgcccuuagaauggucagccgugcuacuacaucuaauuaaacauagagguuacuuaagucaacgcaaaaacgaaggagaaacagcagacaaagaacuaggagcauuacuaaaaggaguggcaaacaaugcacaugccuuacaaacuggugacuuuagaacuccugcugaauuagcauuaaauaaauuugaaaaagaaucuggacacauaagaaaccaaagaggagacuauagucauacauuuucaagaaaggacuugcaagcggaauuaauauuauuauuugaaaagcaaaaagaguucggaaacccacaugugaguggcggccucaaagaaggaauagaaacauuauuaaugacacaaagaccugcucuuucaggcgacgcgguccaaaagaugcuuggacacuguacauuugaaccagcagagccaaaagcugccaaaaacacuuacacugcugaaagauucauaugguugacgaaacucaauaauuuacgaauacuagaacaaggaagugaaaggcccuuaacagauacagagagagcuacguuaauggaugaaccguauagaaaaucaaaacuaacguacgcacaagcaagaaaauuauuaggauuagaggauaccgccuuuuucaaaggacuaagauacggaaaagauaaugccgaagcaucgacacucauggaaaugaaagcauaucaugcaauaucacgugcauuagaaaaagaaggauuaaaagauaagaaaagcccucucaaccucagcagugaacuacaagacgaaauaggaacagcauuuagcuuauucaaaacagaugaagauauaacgggaagacugaaagaucgcguacaacccgaaauuuuagaagccuuauuaaaacacauuagcuucgauaaauucguccaaaucucacuaaaagcacucagaagaaucgugccacuaauggaacaagguaagagauaugaugaggcuugugcagaaauauacggugaucauuacgguaagaaaaacacugaagagaaaauauacuugccaccuauaccugcagaugaaauaagaaauccuguuguucuuagggcauuaucacaagcacgaaaaguuauaaaugguguagugcgcagauauggauccccagcuagaauccauauugaaacagcaagagaaguaggcaagagcuuuaaagauagaaaagaaauugaaaaacgacaagaagaaaauagaaaagacagggaaaaagcagccgccaaauucagagaguacuuuccaaauuuuguaggggaaccaaaaucgaaagacaucuuaaaguuacgacuuuacgaacaacaacauggaaaauguuuauacucgggaaaagaaauaaauuuaguaagauuaaacgaaaaaggauacguagaaauagaucacgcacuaccauuuucaagaaccugggacgacaguuuuaacaauaaaguauuaguauuaggcagugaaaaccaaaacaaaggaaaccaaacccccuacgaauacuuuaauggaaaagauaauaguagagaauggcaagaauuuaaagcaaggguagaaaccagucgauuucccagaucuaagaaacaaagaauccuacuacaaaaauuugaugaagacggauuuaaagaaugcaaucuaaaugacacccguuauguuaacagauucuuaugucaauucguagcagaucacauauuacucacaggaaaaggaaaaagacgaguauucgcaucaaauggccaaauaaccaaucuacuucguggcuuuuggggacuuagaaagguuagagcugagaacgacagacaucaugcgcuugacgccguaguaguagccugcucgacaguugcaaugcaacagaaaaucacuagauuuguaagauauaaagagaugaaugcauuugauggcaagacaauugacaaagagacaggaaaaguauugcaucaaaagacacauuucccucaaccgugggaguucuucgcacaagaaguaaugauacgaguauucggaaaaccagacggaaaaccagaauuugaagaggcugacacaccagaaaaacucagaacauuacuugcagaaaaacugagcucaagaccagaagcaguacacgaauacgucacgccccuauuuguaagcagggcuccaaaccguaaaaugucaggccaagggcauauggaaacuguaaaaucagcaaaacgauuagaugaaggugucuccgucuuacgaguuccauuaacacaauuaaaacuaaaagauuuagagaaaauggucaauagagaacgagaaccaaaacuauaugaagcacuaaaagcccguuuagaagcucauaaagacgauccagcaaaagcauucgcugaaccauucuacaaauaugauaaggcaggaaaccgcacacaacaaguaaaagcuguaagaguagaacaaguacagaaaacaggaguuuggguacgaaaucacaacggaauugcagauaaugcaacaauggugaggguagauguauucgaaaaaggcgauaaauacuauuuggucccuauuuacaguuggcaaguagcuaaaggaauauuaccagaccgagcaguaguacaaggaaaagaugaagaagacuggcaacuaauugaugauagcuuuaauuuuaaauuuucucugcauccaaacgaucuaguagaaguuauaacgaagaaagcaagaauguuuggauauuucgcaaguugucaucggggcaccggaaacauaaauauacguauucaugauuuagaucauaaaauaggaaagaacggcauucuagaaggaaucggagucaaaaccgcacuaaguuuccaaaaauaucaaauagaugaguuggggaaagaaauaagaccaugcagacuuaaaaagaggccuccuguaagauga

SEQ ID NO: 5031 - RNA, 3249 nt, Artificial Sequence
  Cas9 variant
auggcagcauucaaacccaacccgaucaauuacauauuaggcuuagauaucggaauagcgaguguaggcugggcuaugguugaaauugacgaagaugaaaacccaauauguuugaucgaccuagguguacgcguguucgaacgagcagaagugccuaagacuggggauagucuugcuauggcaagacguuuagcaaggucaguaagacgauuaacacgacggagagcacauagauuacuaagagcaagacgauuacugaagcgcgaaggagugcuacaagcugcugauuuugaugaaaauggauuaauuaagagcuuaccuaacacaccguggcaauuacgagcagcugcucuugauagaaaacucacuccuuuagaauggagcgcuguacuauuacacuuaauuaaacauagagguuaccuuagccaaaggaaaaaugaaggagaaacugcugauaaagaacuuggagcacuucucaaaggagucgcugauaaugcgcaugcacuccaaacuggagauuuucgaaccccugcagaacucgcuuuaaacaaguuugaaaaagaaucaggacauauaagaaaucaaagaggagauuauagucacacauucucucgaaaagauuuacaagcagaauuaauacuauuauuugagaaacagaaagaauuuggaaauccgcaugucagcggcggauuaaaagaagggauagaaacucucuuaaugacacagagaccugcacuaaguggagaugcuguacagaaaaugcuaggacauuguacauuugaaccagcagaaccgaaagcagcuaaaaacacauauacagcagaaagauuuauuuggcucacuaaauuaaacaaucuuaggauacucgaacaaggaucagaaagaccacuaacagacacugaacgugcuacauuaauggaugagccauacagaaaaucaaaauugacauaugcacaagcacgaaaacuacuuggucuggaagacacagcauucuucaaaggacuuagauauggcaaggauaacgcagaagcaucuacccuaauggaaaugaaggcuuaccacgcaaucucuagagcauuagagaaagaaggacuaaaagauaagaaaaguccauugaaucuaaguccggaacuucaagaugaaauagguacagccuucaguuuauucaaaaccgaugaagauauaaccggaaggcuaaaagacagaauacagccggaaauacuggaggcuuuacuaaaacacaucagcuuugauaaauucguacaaauuagcuuaaaagccuuaagaagaauaguuccacuuauggaacaaggcaaaagauaugacgaggcuugugcagaaaucuauggagaccacuauggaaagaaaaauaccgaagagaaaauauauuuaccaccaauaccagcugacgaaauccgaaacccaguaguacuaagagcacuuagucaagcucguaaaguaauuaauggagucguucgacgauauggcagucccgcacgaauacacauugaaacagcccgcgaagucggcaaaucguuuaaagaucgaaaagaaauugagaaaagacaagaagaaaauagaaaagacagagaaaaagcggcagcgaaauuucgagaauauuuuccuaauuuugugggagaacccaaaucuaaagauaucuuaaaauuaagauuauacgaacaacagcacgggaaauguuuauauagugggaaagaaauaaacuuagguagacuaaaugaaaaaggauauguagaaauugaucaugcucuaccauucagccgaacaugggaugauucauucaacaauaaaguucuuguauuaggaagcgaaaaccagaauaaaggcaaucaaacaccauaugaauacuuuaacgggaaagauaauucaagagaauggcaggaguucaaagcacgaguagaaacaagcagauuuccgagaaguaagaaacaaagaauacuauugcaaaaauuugacgaagauggauucaaagaaagaaaucuaaaugauacgagauaugucaaccgauuuuuaugucaauucguugcagaucguaugaggcuuaccggaaaagggaagaaaagaguuuuugcgucaaauggacaaauaaccaaucuguuaagaggguucuggggauugaggaaagucagagccgaaaaugacagacaucacgcacuagacgcaguuguuguagcuugcucgacaguagccaugcaacaaaagauaacaagauuuguaagauauaaagaaaugaacgcauuugauggcaaaacaauugauaaagaaacaggugaaguacuacaucagaaaacacacuuuccucaaccaugggaauuuuucgcacaggaaguaaugauaagaguauuuggaaaaccggaugguaaaccagaauuugaagaagcagacacaccagaaaaauuaagaacauuacuggcugagaaauuaucaucacgaccagaagcuguucacgaauacguaacaccacuguuuguaagcagagcaccaaacagaaaaaugaguggucaaggacauauggaaacuguuaaaucugcaaaaagguuagaugaaggaguuuccguccuacgaguuccacugacucaacuaaaacuaaaagaccuagagaaaauggucaaccgcgaaagagaacccaaauuauaugaagcacuaaaagcaagguuagaagcacacaaagaugauccagccaaggcuuuugcagaaccauuuuauaaauacgauaaagcaggaaauagaacacaacaaguaaaagcaguaagaguggaacagguacagaaaacaggaguauggguacgcaaccauaacggaauagcagauaacgcaacaaugguaagaguagauguauucgaaaaaggugacaaauacuauuuaguuccaaucuacaguuggcaaguugccaaaggaauuuuaccugauagagcuguaguacaaggaaaagacgaagaagauuggcaacugauugaugauagcuuuaacuucaaauuuucauuacauccgaaugaccuaguagaaguuaucacaaagaaagcaagaauguucgguuauuuugcaucaugucacagagguacagggaauauaaacauacgaauacaugaccuggaucauaaaauuggcaaaaaugggauucuagaagggauaggagucaaaacagcauuaaguuuucaaaaauaucaaauagacgaacuaggagaagaaauuagacccugcagacugaaaaagagaccacccguaagguga

SEQ ID NO: 5032 - RNA, 3249 nt, Artificial Sequence
  Cas9 variant
auggcagcauuuaaaccaaacccuauaaauuauauauuaggucuagacauaggcauugcuucuguagggugggcaaugguagaaauugaugaagaugaaaacccaauaugcuuaauugauuuaggaguaaggguauuugaaagagcugaagucccaaaaacuggcgauucccuagcaauggccagaagacuggcccgaucaguuagaagauuaacuagacggagagcacacagauuguuaagagcaagaaggcuccuuaaaagagaaggaguacuacaagcggcagauuuugacgaaaacggacuaaucaaaucauuacccaacacaccauggcaauuacgagcugcagcccucgaucguaaauuaacaccauuagaauggagcgcugucuuacugcaucuuauaaaacauagaggauaccucagucaaaggaaaaaugaaggagaaacggcagacaaagaacugggagcuuuacucaaaggaguagcugacaaugcucaugcauuacaaacaggagacuuccgaaccccugcagaacuugcauuaaauaaauucgaaaaagaaaguggacacauaagaaaccaaagaggggacuauagccacacuuuuucacgaaaagauuuacaagccgaacuaauauuacuauuugaaaaacaaaaagaguucggaaacccacauguuucagguggcuuaaaagaaggaauagaaacacucuuaaugacacaaagaccggcacuaucaggugaugcaguccagaaaauguuagggcauuguacauuugaaccagcugaaccuaaagcagccaaaaauacuuacacggcagaaagauucauauggcuuacaaaauuaaacaaucuuagaauacuagaacaagggagcgaaagaccauuaacugauacagaacgagcuacgcucauggaugaaccauacagaaagucaaaauugacguacgcacaagcgaggaaacuguuagggcuagaagauacugcauuuuucaagggauuacgauauggcaaagacaaugcugaagcaucaacccuaauggaaaugaaagcauaucaugcuaucucucgagcauuagaaaaggaaggacuuaaagauaagaaaucuccccuuaauuugucacccgaacuucaggaugagauagguacugcguuuagccuauuuaaaacugaugaagauauaacaggacgauuaaaagacaggauucaaccagaaaucuuggaagcauuacuuaaacauauaaguuucgacaaauucgugcaaauaucacuuaaagcacuaagaagaauagugccauuaauggaacaagggaaaagauacgacgaggcaugugcagaaauauauggagaccacuacggaaagaaaaacacagaagagaaaauuuacuuaccgccaauucccgcagacgaaauaagaaacccaguuguauuaagagcacugucacaagcaagaaaagucaucaauggaguaguccguagauacggaaguccugcaagaauacauauugaaacagcaagagaagucggaaaaucuuucaaagauagaaaagaaaucgaaaaacgacaagaagaaaauagaaaagacagagaaaaggcagcagcaaaauuucgagaauauuucccaaauuuuguaggagaaccgaaaagcaaagacaucuuaaaauuaagacuguaugaacagcaacauggaaaaugucuauacucugguaaagaaaucaauuuaggucgauuaaaugaaaaaggauacgucgaaauagaucaugcacuaccauuuagcagaacaugggacgacucauucaauaauaaaguauuagucuuagguagcgaaaaccaaaauaaaggaaaccaaacuccguaugaauacuucaauggaaaagauaauagcagagaauggcaagaauuuaaagcacgaguugaaacaagcagauucccaaggagcaagaaacaaagaaucuuauuacaaaaauuugacgaagaugguuuuaaggaacgaaauuuaaacgacacaagauacgugaacagauuccuaugccaauuuguagcagaucgcaugagguuaacugggaaaggaaagaaacgaguauuugcaucuaacggacaaaucacuaauuuauuaagaggauuuuggggucuaaggaaaguaagagcagagaacgauagacaccacgcgcuugaugcaguaguaguagcaugcagcacagucgcaaugcaacagaaaauuaccagauuuguaagauauaaagaaaugaaugcguucgauggaaaaacuauagauaaagaaacaggagagguacuccaucagaaaacacauuucccacaaccaugggaguucuucgcacaagaaguaaugauaagaguauucggaaaaccagaugguaaaccagaauuugaagaagccgacaccccagaaaaacuuagaacauuacuugccgaaaaauuaaguaguagaccugaagccguacaugaauauguaacgccuuuauuugucuccagagcgccaaauaggaaaaugucaggacaaggacauauggaaacagucaaaucugcaaaaagacuugaugaaggaguaucaguauugcgagugccguuaacacaacuaaaauuaaaagaucuagagaaaaugguuaaucgugaacgcgaaccaaaacuauaugaagcccuaaaagcaagacuugaagcacacaaagaugauccugcaaaagcauucgcagaaccuuucuacaaauaugacaaagcaggaaaucgaacucaacaaguaaaggcugucagaguggaacaagugcagaaaacaggaguuuggguaaggaaucauaacggaauagcagauaacgccacaaugguaagaguagacguauucgaaaaaggagacaaauacuaccuaguaccuauauacucauggcaaguagccaagggaauacuaccagaucgcgcaguuguccaaggaaaagacgaagaagauuggcaacuuauugacgacaguuuuaauuuuaaauuuaguuugcauccaaaugaucuuguugaaguaaucacaaagaaagccagaauguuugguuacuucgccagcugucacagaggcacagguaauauaaauauaaggauucacgaucuugaucacaaaauugggaaaaauggaauauuagaaggaauaggaguaaaaaccgcccuaaguuuccaaaaguaccaaaucgacgaauuaggaaaagaaauaagaccuuguagauuaaagaaaagaccgcccguaagauga

SEQ ID NO: 5033 - RNA, 3249 nt, Artificial Sequence
  Cas9 variant
auggcagcauuuaaaccaaauccaauuaauuauauauuaggauuggauauaggaauagcaagugucgggugggcuaugguggaaauugaugaagacgaaaauccuauauguuugauagaucuuggaguacgaguauuugaaagagcugaagucccuaaaacgggugacucacuagcagcagcgaggcgucucgcaagaucaguaagaagauuaacacgaagacgagcgcacagacuuuuacgagcccgacgccuucuaaaaagagaagguguacuucaagcagcggacuuugaugaaaauggcuuaauaaaaucguugccuaacacuccauggcaacucagggcagcagcucuagacagaaaacucacaccacuagaaugguccgcuguauuacuacaucuaauaaaacaccgaggauauuuaagucaaaggaaaaaugagggugaaaccgcagacaaagaacuaggagcauuacuuaaagguguagcagauaaugcucacgcacuacaaacaggugacuucagaacuccagcagaacuagcacuaaauaaauuugaaaaagagaguggucauauaagaaaucaaagaggugauuauucacacacauuuaguaggaaagaccuacaagcagaauuaauacuacuauuugaaaaacaaaaagaguucgggaauccacauguaagcggcgguuuaaaagaaggaauagaaacucuucuuaugacacaacgaccagcucucaguggggacgcaguccagaaaaugcuuggucauugcacuuuugaaccagcugaacccaaagcggcuaaaaauacuuacacagcagaaagauucauaugguuaacaaaacuaaauaaucuacgaauccucgaacaaggcagcgaacggccuuuaacagauacagaacgagcgaccuuaauggaugaaccuuauagaaaaagcaaauuaacauacgcacaagcaagaaaauuacucggcuuagaagacacagcguucuuuaaaggguuaagauacggaaaagauaaugcagaagcgucaacacuuauggaaaugaaagcauaccacgcaauaucaagagcguuagaaaaagaaggacuuaaagauaagaaaucaccacuaaauuugucaccagaauuacaagaugaaauaggaacugccuucaguuuauuuaaaaccgaugaagauauaacgggaagauuaaaagauagggugcaacccgaaauauuagaagccuuauugaagcauauaucauuugacaaauuuguacaaauaucauuaaaagccuuaagaagaauuguaccguuaauggaacaaggaaaaagauaugaugaggcuugcgcugaaauauacggugaucacuacggcaaaaagaauacggaagaaaagauauauuuaccaccaauaccggcagacgaaauuagaaacccaguuguucucagagcacuaucacaagcaagaaaaguaauaaauggaguaguaagaagauacggaagcccagcaagaauccauauagaaaccgcuagggaaguaggaaagucauuuaaagauagaaaggaaauagagaaaagacaagaagagaacaggaaagauagagagaaagcagcggccaaauucagagaauacuuuccaaauuucguuggagagccaaaaucgaaggacauacucaaauuacguuuauacgaacaacaacauggaaaauguuuauacaguggcaaagaaaucaaucuaggaaggcuaaaugaaaaaggauauguugaaauugaccaugcauugccauuuucuagaacuugggaugacaguuuuaauaacaaaguauuaguauuagggagcgaaaaucaaaauaaagggaaucaaacaccauacgaauacuuuaauggaaaagauaauucaagagaauggcaagaguucaaagccagaguagaaacaagucgcuuuccuagaagcaagaaacaaagaauauugcuucaaaaauuugacgaagauggcuucaaagaaagaaaucuaaacgauacaagauacguuaauagauuucuuugucaauucguagcagauagaaugagguuaacagguaaagguaagaaacgaguguuugcgucaaacggccaaauaacaaaucuacuuagaggcuuuuggggauuaagaaaaguuagagcagaaaaugaccgacaccaugcucuggaugcaguaguagucgcauguuccacuguagcaaugcaacaaaagauuacgagguuugucagauacaaagaaaugaaugcauuugauggaaaaaccauagauaaagaaacuggagaaguuuuacaucagaaaacacauuucccacaacccugggaguucuuugcgcaagaaguaaugauacgaguauuuggaaaacccgacggaaaaccugaguucgaagaagcagacacaccugaaaaacuacgaacccuacuagcggaaaaauugaguaguagacccgaagcaguacaugaauaugucacaccacucuuuguaaguagagcgcccaauagaaaaaugucaggccaaggucacauggaaacagugaaaucagcaaaacgcuuagacgaaggagucucuguacuacgaguaccucuuacacaauuaaaauuaaaagaccuagagaaaaugguaaauagagaacgagaaccgaaauuauacgaagcauuaaaagcaagacuagaagcucauaaagaugacccggcgaaagcauucgcagaaccguuuuauaaauacgacaaagcaggaaaucgcacucaacaaguaaaagcugugagagucgaacagguacagaaaacaggaguuuggguaaggaaucauaaugggauagcugacaaugcaacaaugguaaggguagacguguuugaaaaaggugauaaauauuauuuaguaccaauauauucauggcaagucgcaaaaggaauuuuaccagauagagcuguaguacaagguaaagaugaagaagacuggcaacucauagacgauucguuuaauuuuaaauuuagucuacacccaaaugauuugguagaagucauuaccaagaaagcaagaauguucggguauuuugcguccugucauagaggaacaggaaauauaaauauacguauacaugaccuggaccacaaaauagguaaaaauggaauauuagaagguauaggagucaaaacugcauugagcuuucaaaaauaccaaaucgaugaacuaggaaaagaaauaagaccaugccgcuuaaagaaaaggcccccgguaagauga

SEQ ID NO: 5034 - RNA, 3249 nt, Artificial Sequence
  Cas9 variant
auggcugcauuuaaacccaauccaauaaauuacauacuuggccuagacauaggaauugcaucuguaggaugggccauggucgaaauugacgaggaagaaaauccaauuagacuuauagacuuaggaguuagaguguucgaaagagcagaaguaccaaaaacaggugauucacuagcgauggcaagaagacuagcucgaaguguuagaagacuaacgcgucguagagcacaccgauuauugagaacaagaagguuacuuaaaagagaaggcguacuacaagcagcgaacuuugacgaaaacggacuaauuaaaagucuuccaaacacacuauggcaacuacgagcagcagcuuuagauagaaaacuuacaccacuagaauggucagcaguauuacuacaucuuauuaaacacagagguuaccuaagucaaagaaagaaugaaggcgaaacggcagauaaagaacuaggagcacuucuaaaaggaguagcaggaaaugcacaugcacuucaaacaggcgauuuuagaacacccgcggaauuagcauuaaauaaauuugaaaaagaaaguggacauaucagaaaucaaagaggagacuauagccauacguuuaguagaaaagaucuacaagcagaacucaacuuauuguucgaaaaacaaaaagaguucggaaauccucacauaagcgacggauuaaaagaagguauagaaacuuuauuaaugacccaacgaccugcacuaucgggagaugcgguacagaaaauguuaggacauuguacauuugagccaacagagccuaaagcagcuaaaaacacauacacaaccgaaagauuuaucuggcuaacaaaauuaaacaaucuccgaauacucgaacaagguucugaaagaccguuaacagauacagaaagagcuacucuuauggaugagccuuauagaaaaucuaaacugacuuaugcucaagcuagaaaauugcucgagcuagaugauauugcauucuucaaaggauuaagauauggaaaagauaaugccgaagcuaguacacugauggaaaugaaagcauaucaugcaauaucacgagcauuggaaaaagaaggauuaaaagauaagaaaagcccauuaaaucuaaguccagaauuacaagaugaaauagggacggcauucaguuuauuuaaaaccgaugaagacauaacaggccgauugaaagauagaauacaaccugagauauuagaggcuuuacucaaacauauuaacuuugauaaauuugugcaaauaucauuaaaagcacuaagacguauaguaccuuuaauggaacaagggaaaagauaugacgaggcuugcgcggaaauauauggagaucauuauggaaagaaaaacacagaagagaaaauagaucuacccccaauuccagcagaugaaauacauaauccagucguacuaagagcacuuucacaagcccgaaaaguaaucaauggaguaguucgcagguauggaaguccagcuagaauacacauagaaacugcgagagagguagguaaaucuuuuaaagaucgcaaagaaauagagaaaagacaagaagaaaacagaaaagacagagaaaaagcagcagccaaauuccgagaauacuuuccaaacuucguaggagaaccuaaaucaaaagauauacucaaauuaagacuuuacgaacaacaacauggaaaaugucuauacagcggaaaagaaaucaaccuaggccgacuaaaugaaaaaggauacguggagauugaccacgcucucccauuuagcagaacaugggaugacucauuuaauaacaagguuuuaguacuaggaagugaaaaucaaaacaagggaaaccaaacaccauacgaguauuuuaacggaaaagacaacucaagagaauggcaagaauuuaaagccagagucgaaacaagcagauuuccaagaagcaagaaacaacgaauauuguuacaaaaauuugaugaagaugguuuuaaagaaagaaacuugaaugauaccagauauguaaaucgauuuuuaugccaauuuguagcugacagaaugcgacuaacaggcaaaggaaagaaaagaguuuuugcaaguaauggacaaaucacuaaucuacuuaggggauuuuggggucuacgaaaaguuagagcugaaaacgaccgccaucacgcauuagacgcaguagucguggccugcaguacaguggccaugcaacagaaaauaacuagguuuguacgcuauaaagaaaugaacgccuuugacggaaaaacgauagacaaagaaacgggagaaguacuccaucagaaaacccauuuuccacaaccuugggaauuuuucgcacaagaaguaaugaucagaguauuugggaaacccgaugggaaacccgaauuugaagaagcagacacaccagaaaagcuccguacacuccuuaccgaaaaauuaucaucaagaccugaagcuguacaugaauauguaacaccucucuucguaucgagagcacccaauagaaaaaugucaggacaaggccauauggaaaccguuaagagugcaaaaagauuagaugaaggaauaucaguguuaaggguaccccuaacucaacuaaaacugaaagauuuagagaaaaugguuaacagagaacgagaaccuaaacuauaugaagcucuaaaagcccgacuagaagcacauaaagacgauccugcaaaagcauuugccgaaccauuuuauaaauacgauaaagcaggcaacagaacccaacaagugaaggccaugcgaguggaacaaguacaaaagacaggaguaugggucagaaaccacaauggcauugcagauaacgcaacaauggugagaguagaugucuucgaaaaaggcgacaaauacuauuuaguccccauauacaguuggcaaguagccaaaggaauuuugccugaucgagcaguagugcagggaaaggaugaagaagacuggcaacuaaucgaugauaguuuuaacuuuaaauuuucauuacauccaaacgaccuagucgaaguaauaacuaagaaagcuaggauguuuggauauuucgccucaugucacagaggaaccggaaauauaaacauuagaauacacgaccuugaucauaaaauugguaaaaacgggauacuagaaggaauagguguaaaaaccgcacuauccuuccaaaaguaucaaauugaugaacuaggaaaagagauaagacccugcagacuaaagaaaagaccaccaguaagauga

SEQ ID NO: 5035 - RNA, 3249 nt, Artificial Sequence
  Cas9 variant
auggcagcauuuaaaccuaacccuauuaauuacauucucggccucgauauugguauugcaucagucggaugggcuaugguagaaaucgacgaagaugaaaauccaauauguuuaauagaucuaggaguaagaguuuuugaaagagcagaaguaccaaaaaccggagauagccuagcgauggcaagaagacuagcaagaucaguaagacguuuaacaagaaggagggcucauagguuacucagagcuagacgauuguuaaaaagagaaggcguauuacaagcagcagacuuugaugaaaauggauuaauuaaaagucuccccaauacgcccuggcaauugagagcugcagcauuagaucgaaaacugaccccacucgaauggucagccguacuauuacaucuaauuaaacauagaggauaucucagccaacggaaaaaugaaggggaaacagcagauaaagaauuaggagcguuauugaaaggaguugcagauaaugcacacgcacuacaaacaggagacuuuagaacaccagcagaauuagcacuuaauaaauucgaaaaggagucaggacauauaagaaaccaaagaggcgacuauucacauaccuucuccagaaaagaucuucaagcugaauugaaccuacuauucgaaaagcaaaaagaguucggcaauccucacauuucagauggccuuaaagaaggaauagaaacacuauuaaugacucaaagaccagcauuaaguggagacgcuguacagaaaauguuaggacauuguacauuugaaccggcagaaccaaaggcugcuaaaaacaccuauacggcagaaagauucauauggcucacaaaacuaaacaauuugcgaauuuuagaacaaggaucagagcgcccacuaacugacacagaacgaacuacauuaauagaugaaccuuaccguaaaaguaaguuaacauaugcacaagcacgaaaauuguuagaauuagacaauaccgcauuuuucaaaggacugagguaugguaaagauaacgcagaagccucaaccuuaauggaaaugaaagcauaccaugcgauaagccgagcauuagaaaaagaaggacuaaaagauaagaaaaguccauuaaauuuaucuccagaacuccaagaugagauagggaccgcauucagucuguucaaaacugacgaagauauaacaggcagacuaaaagacagaguccaaccagaaauccucgaagcauuauuaaaacauauaaguuuugauaaauucguccaaauaucauuaaaagcgcuaaggcguauaguaccgcucauggaacaaggaaaacgguaugacgaggcuugugcagaaauauacggagaucacuauggaaagaaaaauacugaagagaaaauugauuuaccacccauucccgcggacgaaauaagaaacccagucguuuuacgagccuuaagucaagccagaaaaguaauuaauggaguaguccgcagauacggaucgccggcuagaauacauauugaaacagccagagaagugggaaaaucuuuuaaagacaggaaagaaaucgaaaaacgacaagaagaaaauagaaaagauagagaaaaagcagccacaaaauucagagaauauuuuccaaacuuugucggugaacccaaaucuaaagacauacuuaaauuaagauuauaugaacaacaacauggaaaaugcuuauacucaggaaaagaaauuaaccuagguaggcugaacgaaaaagguuacguagaaauagaucaugcacuaccguucucacgcacaugggaugauaguuucaacaauaaagucuuaguccucggaucagaaaaucaaaauaaaggaaaucaaacaccauaugaauacuucaaugguaaagacaauagcagagaauggcaagaguucaaagccagaguugaaacaucccgauuuccccgaucuaagaaacaaagaaucuuauuacaaaaauucgacgaagaaggauuuaaagaacgcaaccuaaacgacacaagauauguaaauagauuucugugucaauucguagcagaucauaugcuucuaaccggaaaagguaaaagaagaguuuuugcuucaaacggccaaauaacgaauuuacuaagaggauuuugggggcuaagaaaaguacgagcugagaacgacagacaucacgcacuagaugcaguugucguagcuuguaguacagucgcaaugcaacagaaaaucacacgauucguacgauauaaagaaaugaaugcuuucgaugguaaaacuauagacaaagaaaccggugaaguauuacaucagaaaacacacuucccacaaccaugggaauuuuucgcacaagaagugaugauaagaguuuuugguaaaccagacggaaaaccggaguucgaagaagcagauacaccugaaaaacucagaacacuauuagcagaaaaacuaagcagcagaccugaagcuguucacgaauacgucacaccacuauucguaagccgagcuccaaauagaaaaaugucaggucaagggcauauggaaaccguuaaaucagccaagagauuagaugaaggcgucaguguucuaagaguuccccuaacacaauuaaaauuaaaagacuuagagaaaaugguaaaucgcgaacgagaaccaaaauuauaugaagcacugaaagcacgauuagaagcacauaaagacgauccugcuaaagcauuugcagaaccuuucuauaaauaugauaaagcagggaauaggacucaacaagugaaagccguaagaguugaacaaguucagaaaacuggaguuuggguaaggaaucauaauggaauugcugauaacgcaacuaugguacguguagacguauucgaaaaaggugauaaauacuaccuagucccgauauacucauggcaagucgccaaagguauucuuccagacagggcugucguacaaggaaaagacgaagaagauuggcaacugaucgacgauaguuucaacuuuaaauucucgcuucauccgaaugaucuaguagaaguuauaacaaagaaagcucguauguucggauauuuugccucaugucaccgcggaacaggaaauauuaacauucguauucacgauuuagaccauaaaauuggcaaaaacgggauucuagaaggaaucggaguuaaaaccgcucucuccuuucaaaaauaccaaauagacgaauuaggcaaagaaauaagaccauguagauuaaagaaaaggccaccaguaagauga

SEQ ID NO: 5036 - RNA, 3249 nt, Artificial Sequence
  Cas9 variant
auggcagcguucaaacccaauccaaugaauuacaucuuaggacuagauauaggcauagcuucuguaggaugggcaauagucgaaauagaugaagaagaaaaucccauaagacugauagacuuaggaguacgaguauuugaaagggcugaaguuccaaaaacaggagauucacuagcagcagcaaggcgacuagcucgaucaguuagaagacuaacaagaagacgugcacauagguuacuaagagcaaggagguuauuaaaaagagaaggcgucuuacaagcugcagauuucgaugaaaacggacuaauaaaaucacuaccaaauacgccuuggcaauuacgugcugcggcauuagauagaaaacuaacaccgcuugaauggucagccguauuacuccaccuuaucaaacauagaggguaccuaucucaaagaaagaaugaaggggagaccgcugauaaagaguuaggagcuuuacugaaagguguggcagauaacacacacgccuuacaaacaggagacuucagaaccccugcagaacuagcacucaacaaauuugaaaaagagucuggucauauuagaaaccaacgaggagacuauucacauaccuuuaacagaaaagacuuacaagcggaacuuaaccuauuauuugaaaaacaaaaagaguucggaaacccacacgugagcgacggacuaaaagaagguauugaaacguuauuaaugacacaacgaccagcacuaucaggagaugcuguucagaaaaugcucggacauugcacauucgaaccaacggaacccaaagcagcuaaaaauacuuacacagcugaacgauucguuugguuaacuaaacuaaacaauuuaagaauauuagaacaaggaagugaaagaccccuaacagauacugaaagggcuaccuuaauggacgaaccauaccgaaaaagcaaacuuaccuacgcacaagcaagaaaacuacuagaucuagacgacacagcauucuuuaaaggacuuagguacggaaaagauaaugcagaagcaucaacacucauggaaaugaaagcauaucaugcuauaagcagagcauuagagaaagaaggguuaaaagacaagaaauccccgcuuaaucuuaguccugaauuacaagacgaaauaggaacugcauuuuccuuauuuaaaacagacgaagauauaacagguagauuaaaagauagaguacaaccagagauauuagaggcccuauuaaaacauaucagcuuugauaaauuugugcaaaucucauuaaaagcacuucgccgaauuguaccauuaauggaacaggguaacagauacgacgaagcaugcacugaaauauauggcgaccauuacggaaagaaaaacacagaagagaaaauuuacuuaccuccaauaccagcugacgaaauccguaauccuguaguacuacgagcacuuagucaagcacgaaaaguaauaaacggaguaguuagaagauacggaucuccagcucgaauacacaucgaaacagcacgugaaguagguaaaucguucaaagaucggaaagaaauugagaaaagacaggaagaaaacaggaaagaccgcgagaaaagugcugcuaaauucagagaauacuuuccuaauuuugucggcgaaccaaaaagcaaagacauuuuaaaacuccgacuauacgaacaacaacacggaaaaugucuuuauaguggaaaagaaauaaaccucgguagacuaaaugaaaaaggauacguagaaauagaucaugcucucccuuuuaguagaacgugggacgauaguuuuaauaacaaaguacuagcauuaggaucugaaaaccaaaauaaagguaaucaaacuccuuacgaauauuuuaauggaaaagauaauucaagagaauggcaagaauuuaaagcaagagucgaaacuucacgcuuuccaagaucaaagaaacaaagaauacugcuccagaaauuugaugaggacggauuuaaagaacggaaucuaaaugacacuagguauauaaauagguuuuuaugccaauuuguugcagaucacaugcuauugacuggcaaaggaaaacgaagaguauuugcgagcaauggacaaauaacaaacuuauuaagaggcuuuuggggauugagaaaaguacgagcugaaaaugaccgucaccaugcguuggaugcaguuguaguagcauguucuacgauagcgaugcaacagaaaauaacccgguuuguaagauacaaagaaaugaaugccuucgaugguaaaaccauagauaaagaaacaggagagguacuccaucaaaaagcacauuucccccaaccaugggaguucuuugcgcaagaaguaaugauaaggguauucggaaaaccagaugguaaaccggaauuugaagaagcagauacacccgaaaaauuacgaacucuauuagcagaaaaacuuucauccagacccgaagcaguacauaaauacgugacaccguuauuuauaucuagagcaccaaaucgcaaaaugucugggcaaggacacauggagaccguaaaaucagcaaagagauuagacgaaggaaucucuguacuaagagucccauuaacucaauuaaaauuaaaagacuuagagaaaauggucaacagggaaagagaaccaaaauuauacgaagcucuaaaagcucgacuagaagcacacaaagaugaucccgcuaaagcauucgcggaaccauucuacaaguacgauaaggccggcaacaggacucaacaaguaaaagcuguaagaguagaacaagugcagaaaacaggaguauggguucauaaucauaauggaauugcugacaaugcaacgauaguaagaguagacguuuuugaaaaaggugguaaauauuaccuaguuccuauuuauucauggcaaguagcuaaagguauccuuccggacagagcuguugugcaaggaaaagaugaagaagauuggacaguaauggaugacagcuuugaauuuaaauuuguacuauacgcaaaugauuuaauuaaauuaacggcuaaaaagaacgaauuuuuagguuauuucgucucauuaaauagagcaacgggagcaauagauaucagaacccaugauacagacucuaccaaaggcaaaaacggaauauuucaaucaguaggaguuaaaaccgcacuaaguuuucaaaaauaucaaauagacgaacuaggaaaagaaauaagaccaugccgacuuaagaaaagaccuccugucagguga

SEQ ID NO: 5037 - RNA, 3249 nt, Artificial Sequence
  Cas9 variant
auggcagcauuuaaacccaauucaauuaauuacauacucgguuuggauaucgguauugccaguguagguugggcaauggucgaaauagacaaagaagaaaacccaauccgacuuauagaucuaggaguuagagucuucgaaagggcagaaguaccuaaaacaggugauuccuuagcagccgcacgccgacucgcaaggucagugagacgacuaacaagaaggagagcucacaggcuacucagaacaagaagguuacugaaaagggaaggaguucuacaagcagcgaacuuugauaaaaauggauuaauaaaaucuuuaccaaacacauuauggcaauuacgagcggcugcacuagauagaaaacuaacgccacuugaauggucagcaguacuacuacacuuaauaaaacauaggggauauuugagccaacgcaaaaacgaaggagaaacagcggacaaagaauugggagcauuacuaaaaggagucgcaggaaacgcccaugcucuacaaaccggugauuuuagaaccccugcagaacuagcacuaaauaaauucgaaaaagaaucaggacauauacguaaucaaagaggagacuauucacacacauuuucaagaaaagauuuacaagcugaacuuaauuuacucuuugagaaacagaaagaauuugguaacccccauauaaguggaggccucaaagaagggauagagacauuacuuaugacccaaagaccggccuuaaguggggacgcaguacagaaaaugcugggucacugcacauuugaaccaacugaaccaaaagcagcuaaaaauacuuacacaaccgaacguuucauuuggcuaaccaaauuaaauaacuuaaggauuuuagagcaaggaucagaaagaccauuaacagauacagaaagagcaacacucauggacgaaccauaccgaaaaucaaaauuaacauacgcacaagcaagaaaacuacucucucuagaagauacagccuuuuucaaaggauuaagguauggcaaagauaacgccgaagcgucaacuuuaauggaaaugaaggcguaccacacaauuagcagagcacuagaaaaagaaggguuaaaagauaagaaaucuccucuaaaucuaucucccgaacuacaagacgaaauagguacugcguuuagccuauuuaaaacagacgaagauauaacaggaagguuaaaagacaggauacaaccagaaauauuagaggcauuauuaaaacacauaaguuucgauaaauucgugcaaauaucauuaaaagcucuaagaagaauaguuccucuuauggaacaagguaaaagauacgaugaagcaugcgccgaaauuuauggugaccauuacgggaagaaaaauacagaagagaaaauauauuuacccccaauaccagcggaugaaauaagaaauccagucguacucagagcguuaagucaagcaagaaagguuauaaaugguguggugagacgauauggaaguccugcaagaauacauaucgaaacagcaagggaaguaggaaaaucauuuaaagacaggaaagaaauagaaaagagacaagaagaaaauaggaaagaucgggaaaaagcugccgcaaaauuccgugaauacuucccaaauuucgugggggaaccaaaaucaaaggauauacuaaaauuaagacuuuaugaacaacaacauggaaaaugccuauauucaggcaaagaaauuaaucucguaagacuaaacgaaaaaggcuauguugaaauagaucacgccuuaccguuuuccaggacuugggacgauaguuuuaacaauaaaguuuugguccuuggcucagaaaaccaaaauaaaggcaaucaaacaccauaugaauacuuuaauggaaaagacaacucgagggaauggcaagaauuuaaggcaagaguagaaacaucacguuuuccuagauccaaaaagcaaagaauauuacuccaaaaauucgacgaagacgguuucaaagaaagaaaccuuaacgacacgcgauauguuaauagauuucuuugccaauuuguagcagaccacauuuuacuaacaggcaaaggaaaaagaagaguguuugcgucaaauggacaaauaacuaacuugcuacgcgguuuuuggggacuacgaaaaguacgcgcugaaaacgauagacaccacgcccuggaugcaguuguaguagcauguucaacagucgccaugcaacaaaagauaaccagauucguucgauauaaagaaaugaaugcauuugauggaaaaacgauagauaaagaaaccggagaaguccuucaucagaaaacucacuuuccacaaccaugggaguucuucgcacaagaaguaaugauucguguuuuuggaaaaccagauggaaaaccagaauuugaagaagccgauacuuuagaaaaacuaagaacauuguuagcagaaaaauugucaagucguccugaagcaguacaugaauaugucacaccgcucuuuguaucucgagcaccaaauagaaaaauguccggccaagggcacauggaaacaguaaaaucggcaaaaagacuagacgaaggagugucaguauuaagagucccguugacacaauuaaaauugaaagaucuagagaaaaugguaaaucgcgaaagagaaccaaaacuauaugaagccuuaaaagcaagacuagaagcacacaaagaugacccugcaaaagcauucgcugaaccauucuacaaauaugacaaggcgggaaacagaacacaacaagucaaagcaguacgaguagaacaagugcagaaaaccggaguauggguccgaaaucauaacggaauagcagacaaugcaacgaugguuagaguugacguuuuugaaaaaggagauaaauauuauuugguaccaauuuauucauggcaaguagcaaaaggaauauuaccagauagagcaguaguacaaggaaaagacgaagaagauuggcaacuaauugacgacucauuuaacuucaaauuuagucuucauccgaaugacuuaguagaaguaauaacaaagaaagcuagaauguucggauauuuugcuucaugucacagagguacaggaaauauaaacauaagaauacacgaucuggaucacaaaauagggaaaaacggaauacuagaaggaauaggagucaaaacggcccucucuuuccaaaaauaucagauagaugaauuaggaaaagaaauaagaccauguagacuuaagaaaagacccccaguuagguga

SEQ ID NO: 5038 - RNA, 3249 nt, Artificial Sequence
  Cas9 variant
auggcagcauuuaaacccaaucccauaaacuacauucuaggacuagacauuggaauagccucaguaggaugggcaauggucgagauagaugaagaagaaaaccccauaagacuaaucgauuuaggaguacgagucuuugaaagagcggaaguuccuaaaacaggagacucacuagcuaugguuagaagacucgcaaggaguguaagaaggcugacuaggcggagagcacauagacuccucagagcuagacgauuauuaaaacgcgaaggagucuuacaagcagccgauuuugaugaaaacggacuaauaaaaucuuuaccaaauacacccuggcaacuacgggcggcggcacuagacagaaaacucacaccauuagaauggagugcaguucuauugcaucuaauuaagcaucggggauacuuaucacaacguaaaaacgaaggagaaacagcagauaaagaauuaggugcucuauuaaaaggaguagcagacaacgcacaugcacuucaaacaggcgauuucagaacuccggcagaacuagcauugaauaaauucgaaaaagaaagcggccacaucaggaaccaaagaggagauuauagccacacuuucagccguaaagaccuccaagcagaacucauauuacuuuucgaaaaacaaaaagaguuugguaacccucauauauccgggggacuaaaagaaggaauugaaacucuauuaaugacacaaagaccagcucuauccggagaugcagugcagaaaauguuaggacauugcacauucgaaccugcagaacccaaggcagcuaaaaauacauauaccgcagaaagguuuauuuggcuaacaaaauuaaauaauuuaagaaucuuagaacaaggaagugaaagaccucugacugauacagaacgugcaacauugauggacgaaccauaucgcaaaucaaaacugacauaugcacaagcacgcaaauuauuaggauuagaagacacggcauuuuucaaaggacuuagauacggaaaagauaaugccgaagcaagcacauuaauggaaaugaaagcauaucaugcaauaagccgcgcauuagaaaaagagggacuaaaggacaagaaaagucccuugaaucuuaguccggaauugcaagacgaaaucggaacagccuuuucacuauuuaaaacagaugaagacauaacuggaagauuaaaagaucgaauacaaccugaaauacuggaagcacuauuaaaacauaucaguuucgauaaguucguacaaauaaguuuaaaagcacuaagaaggauugucccacucauggaacaaggaaaaagauaugacgaagcaugugcagaaaucuacggagaucauuauggcaagaaaaacacugaagagaaaauauacuuaccaccuauuccggcagaugaaauacguaacccugugguauuacgagcacuaucacaagcuaggaaaguaauaaauggaguaguccgaagauauggaucuccagcacgcauucacauagaaaccgcaagagaaguagguaaaucauuuaaagacagaaaagaaauagaaaaacgucaagaagaaaacagaaaagauagagaaaaggcagcggcaaaauuuagagaauauuuucccaauuuuguaggagagccuaagaguaaagacauauuaaaauuacgccuauacgaacaacaacauggcaaaugucuauauagcggaaaagaaauaaauuuaggacgucuaaaugaaaaaggcuauguagaaaucgaucacgcauuaccauuuucacgaacuugggacgacucauuuaacaacaaaguauuaguauuaggaagcgaaaaccaaaauaaaggaaaccaaacgcccuaugaauauuuuaacggaaaagauaacaguagagaguggcaagaguucaaagcccgaguagaaacaucacgauuuccgagaagcaaaaagcagcgaauacuuuuacaaaaauuugacgaagauggauucaaagaaagaaauuuaaaugauacaagauauguuaacagauuucuuugucaauuuguagcagaucgaaugcgucuaacaggaaaagguaagaaaagaguuuuugcuucaaauggccagauaacuaacuuacuuagaggauuuuggggucuucguaaaguaagggcugaaaaugaccggcaucaugcacuagacgcaguugucguugcaugcucaacaguagcaaugcaacagaaaaucacucguuucgugcgauacaaagaaaugaacgcauuugauggaaaaacaauagauaaagaaacaggagaaguuuuacaccagaaaacacacuuuccacaaccuugggaguucuuugcccaagaaguaaugauuagaguauuuggaaaaccagacggaaaacccgaauuugaagaagcggauaccccagaaaaacucagaacacuuuuagcagaaaaacucucaucaagaccagaagcaguacacgaauacguaacuccauuauuuguuagccgagcaccaaauagaaaaaugucaggucaaggacacauggaaacagucaaaucugcuaaacgacuugaugaaggaguaucuguacuacgcguuccacucacacaacuaaaacuuaaagaccuagagaaaauggucaaucgcgaaagagaaccuaaacucuaugaagcacuaaaagcaagacuagaagcacauaaagaugacccagcaaaagcguuugcggaaccauucuacaaauaugauaaagcagggaacaggacacaacaaguaaaggcuguaaggguagaacaaguucagaaaacuggaguauggguccgcaaucauaacggaauugcagacaacgcuacaaugguaagaguugauguauuugaaaaaggcgauaaauacuacuuaguaccaauuuauucauggcaaguagccaaaggaauauuacccgacagagccgugguucaaggaaaggacgaggaagacuggcaacucauagaugacucuuucaacuucaaauuuagucuccauccaaacgauuuaguugaaguaauaacuaagaaagcaagaauguucggguacuucgcaucuugucacagaggaacaggaaacaucaacauccgaauacaugauuuagaccauaaaauagguaaaaacggaauauuagaaggaauaggagucaaaacggcacucucguuucaaaaauaucaaauagaugaacucggaaaagaaauacggcccugcagacuaaagaaaaggccacccguaagauga

SEQ ID NO: 5039 - RNA, 3249 nt, Artificial Sequence
  Cas9 variant
augagaguucuaggauuagaugcgggaauagcgucauuaggcugggcacuaauagaaauagaagaaaguaauagaggggaacuaagccagggaacuauaaucggcgcaggaacguggauguuugaugcgccagaagagaaaacacaggcgggugcaaaacuaaaaucagaacaacgaagaacauuuagaggacaaaggaggguagucagacgcagaagacaaagaaugaaugaaguaagacgaauuuuacacagucauggacucuugccaucaucagacagggacgcuuugaaacaacccggauuagacccguggagaauaagagcagaagcacuugaucgacuuuuaggaccaguagaacuagcuguugcacuaggacauauagcacgacaucggggauucaaaucaaauaguaaaggagcuaagacuaaugacccagcagacgauacaucgaaaaugaaaagggcugugaaugaaacacgugaaaaauuagcgagauuuggaucagcagccaaaaugcuaguggaggacgaaaguuuuguuuuaagacagacaccaacgaaaaauggggcaagugaaauagucagaagguuuagaaauagagaaggggauuacaguagaucacuucuaagagaugauuuggcggcagagaugagagcccuuuuuacagcacaagcuagauuucaaucagcuauagcuacugcugauuuacaaaccgcauucacaaaagcagcuuucuuucaaaggccacuacaagauucagagaaauuaguugguccaugcccuuuugaaguugacgagaaaagagcuccaaaaagaggauacucguuugaacuuuuuagguuuuuaagccgacuuaaccauguaacacucagagacgggaagcaagaaagaacuuugacccgagaugaauuggcuuuagcagcagcagauuuuggagcagcagcaaaaguaucauuuacagcacuaagaaagaaacuaaaauuaccugaaacaacuguuuuuguuggaguaaaagccgacgaagaaaguaaauuggauguaguggccagaucugguaaggcagcagagggaacugcaagauuacguucaguaauaguagaugccuuaggagaauuggcuuggggagcauuauuaugcucaccagaaaaacuagauaaaauugcagagguaauaucauuccgaagcgacauaggacgaauaucagaagguuuagcacaagcaggauguaacgcgccuuuaguugacgcacuuacagcagcggcuucugauggucgguuugacccguucacaggcgcaggacauauuucgagcaaggcagcaagaaacauacugucugggcuaaggcaggggaugacauaugauaaagcguguugcgcagcagauuaugaccacacagcuucaagagagagaggugcauucgauguagguggccacggaagagaggcauuaaaaagaauuuuacaggaagagaggauaaguagagaauuaguaggcuccccaacagccagaaaggcgcuaauugaaaguauaaagcaaguaaaagcuauuguggaaagauauggggugccagauagaauacauguagaauuagcucgagauguaggaaaaucaauugaagaacgagaagaaauaacuagaggaauagaaaaacgaaaccgacaaaaagauaaacuuagaggauuauuugagaaagaaguuggaaggccaccacaagauggggcaagaggaaaggaagaauuauugagguuugaauuauggagugaacaaaugggaagaugucucuauacagaugauuacauaucaccaucacaauugguugcaacagacgaugcaguacaaguagaccauauauugccauggucacgauuugcugaugauucauaugcgaauaaaacauuauguauggccaaagcaaaccaggauaagaaaggaagaaccccauaugaaugguucaaagcggagaaaaccgacacagaaugggacgcguucaucguaagaguggaagcacuugcagauaugaaaggauuuaagaaaagaaauuauaaacucagaaacgcagaagaagcagcugcaaaauucagaaacagaaauuuaaacgauacucgaugggcgugcagacucuuggcagaagcauuaaaacaauuguauccaaaaggagaaaaagauaaagacggaaaagaaagacgaaggguguuuucaagaccaggagccuuaacugauagauuacguagagccuggggauuacaauggaugaagaaaucaacaaaaggagaccgcauuccggaugacagacaucaugcucuugacgcgaucguaauagcugcaacaacagaaucacugcugcagagagcaacaagggaagugcaagagauagaagauaaagggcuacauuacgaucuagucaaaaauguaacuccaccuuggccaggauucagggaacaagcgguugaggcuguagaaaaaguauuuguggcgagagcugaaaggagaagggcgaggggaaaagcucacgaugcaacgauaaggcauauagcaguaagagagggagaacaacggguuuacgagagaagaaaaguugcugaauuaaaauuagcugacuuagauaggguaaaagacgccgaaagaaacgcuagauuaauagaaaaacuaaggaacuggauugaagcuggaaguccaaaagaugaucccccauuaaguccaaaaggagauccaauauucaaaguaaggcuaguaacaaaaucaaaagugaacauagcauuagacacaggaaacccaaaacgaccuggaacagucgaucgaggcgaaauggcacgaguggauguuuuccgcaaagcuaguaagaaaggaaaauaugaauacuaucuaguaccuauauauccacacgauauagcaacaaugaaaacaccuccaauuagagccguacaagcauauaaaccagaggaugaguggccagagauggauucaucauaugaguucugcuggucuuuaguaccaaugacguaucuacaaguuauaaguagcaaaggagaaauauuugaaggguauuacagaggaaugaauaggucuguuggugcgauacagcuaagcgcccauucaaauaguucagauguugugcagggaauaggagccagaacguuaacugaguucaagaaauucaacguagacagauucgggagaaaacacgaaguagaacgagaauuaagaacauggagaggagaaaccuggcgagggaaagcguauauuuga

SEQ ID NO: 5040 - RNA, 3255 nt, Artificial Sequence
  Cas9 variant
augaaaaacaccuuauauggaauaggcuuagacauaggaguagcuucuguaggaugggcuguaguaggacuaaauggcacuggcgaaccaguaggucugcaucgucucggaguacgaauauucgauaaagccgaacagccuaaaacuggugaaucauuagcugccccgagaagaauggcaaggggcaugagacgaagacucaggagaaaagcgcuaaggagagccgaugucuaugcucuacuagaaagaucaggccuaucgacaagagaagcauuagcacacauguuugaagcgggcggccuagaagauauauaugcacuaagaacccgagcauuagaugaaccaguggguaaagcagaguucagccgaauuuuacuacacuuggcucaaagaaggggauuuaaaucaaaccgaagaacagcuagugauggcgaagauggcagauuguuggccgcugugaacgaaaaucgcagaagaauggcacagggaggguggagaaccgucggagaaaugcuauauagacaugaagcauuugcacuacauaaaaggaauaaagcagacgaauaccuaucaacgguaggaagagauauggucgcugaagaagcaagucuacuauuucaaagacaaagggaguuggggugugccugggcaacaccagaauuacaagcagaauaucugucaauacuacuuagacaacgaucauuugacgaaggaccagggggaaacucaccauauggagguaaucaagucgagaaaaugguaggaagauguacguucgaacccgaugaaccaagagcugcaaaagcggcauauagcuucgaauacuucagccucuuacagaaaaucaaucacaucagauugguagaaaauggugaaacaaggccacuaacucaacaacaacgucagcaauuacuaagucucgcacacaaaacaccugaugucagcuuagccagaauaaggaaggaacuugcacucccggaaacggugcaauucaacggagugagaugcagagcaaacgaaacucuagaagaaagugaaaagaaagaaaaauuugcgugucugcccgcauaucauaaaaugagaaaagccuuagacggaguaguuaaaggaagaaucagcucucuaaguaucagucaaagagaugcagcagccacagcucuuagucuauacaaaaaugaagauacauuacgagcaaaauuaacagaagcaggcuuucaagcuccagaaaucgaugcucuagcuggauuaaccggguucucuaaauuuggacaucuaagucugaaagcauguagaaaauuaauaccucaucuugaacaaggacuaaccuacgaucaagccuguagugcagccggguaugacuuuaaagggcauggcgcuggugaaagagcauucacacuaccugcagcagcaccagaaauggaacaaauaacuucuccaguaguucgaagggcaguagcacaaacaauaaaagucguuaacgggaucauaagagaaauggacgcaucaccggcauggguuagaauagaacuagcgcgcgaauuauccaaaacauuuggggaaagacaagaaauggaucguucgaugagagaaaacgccgcacagaacgaaagacuaaugcaagaacuucgugacacauuucaucugcuaucacccacugggcaagaccuuguaaaauauagacuuuggaaagaacaagauggaguuugcgcuuacucacuaagacguuuggacguagaaagacuauuugaaccgggcuacguagacguugaucacauaguaccauauucacuuagcuucgaugauagacgcucaaauaaaguucucgugcucucaucagaaaaucgucaaaaagguaauagauuaccauuacaguaucugcaaggaaaaagaagagaggacuuuauuguauggacgaacaguagcguuagagacuaccgaaaaagacaaaaucucuuaagagaaaaacugucaggcgacgaagcagagggguuucggcaaaggaauuugcaagauacucaacauauggcaagauuuuuauauaauuacauaagugaucaucuggcauucgcucaaucagaagcccuuggaaagaaacgggucuuugcagucagcggagcugugacaagucaucuucgcaaacgguggggacuuagcaaaguaagagcagauggagauuuacaucaugcacuggaugcggcagucauagcuuguaccacagauggcaugauacgaagaauaagcggauacuacggacacauugagggagaauaccuacaagaugcagacggagcaggaagccaacacgcaagaacuaaagaacguuuuccugcaccuuggccccgauuucgagaugaacuaauaguaagacuaagcgagcaaccaggagaacaucugcuagauauaaauccggaguucuauugugaauaugggacagaacacauaagaccaguauucguaucacgaaugccuagaagaaaagucacuggcccaggacacaaagaaacgauaaagggagccgccgcugcagaugaaggccuacuuacaguaagaaaagcucuaacagaacuaaaacuugauaaggauggagaaauuaaagacuauuacaugccaagcagugauacguuauuauacgaagcacucaaagcucaauuacgacgcuuuggaggagauagcaagaaagcauuugcagaaccauucuacaaaccaaaagccgaugguaccccaggaccucuaguaagaaaaguaaaaacuacagaaaaagccacacuaaccguuccagugcauggaggagcugcaucaaacgacacuaugguaagaguagauguauuuuuggugccaggagacggauacuauugggugccgguauauacagcggacacgcuuaaaccagaacuaccaaacagggcaguaguacaaggaaaaccuuauucugaauggaaagaaaugcgagaagaagacuuuauauuuagccuauacccaaacgaucuaguauauguugaacacaaaucagggcuaaaauucaccuuacagaacgcagauaguacauuagagaaaacccgaacacaaaccucggcauuuguauauuuuguaggugguucaauaagcacagcuucaauaacaauaagaacacaugacaaugcuuacggcaucccaagccuaggaguuaaaacuuuaaaaaccuuccauaaauaucaaguagauguauuaggaaauguauucccaguacauaaagaaacaagacaaaaauuuagguga

SEQ ID NO: 5041 - RNA, 3255 nt, Artificial Sequence
  Cas9 variant
augaaaaacacucuauauggaaucggucucgauauagguguagcaaguguugguugggcagugguuggacuuaauggaacaggugagccaguuggauuacacagguuagguguaagaauauuugauaaagcagaacaaccaaagacaggagaaaguuuagcagcaccaagaagaauggcaagaggcaugagacgaagguugagaagaaaagcguuaagacgagcggauguuuacgccuuacuagaacgaucaggacuaagcacgagagaagcauuagcacaaauguuugaggcggguggacucgaagacauuuaugcucuaagaacaagagcauuagaugagccaguaggaaaggccgaauuuucaagaauacuuuugcaucuagcacaaagaagaggguuuaagagcaauagaagaaccgcuuccgauggagaagauggaagguuacuagcagcagugaacgaaaauaggagacgaauggcacaagggggauggcgcacaguaggagaaaugcuauaucgacacgaagcauuugcauuacacaaaagaaacaaagcugacgauuaucuaucaacuguaggaagagauaugguagcugaagaggcuucauuauuauuucaaagacaaagagaacuggggugugcaugggcaacaccagaacuacaggcggaauaccuaaguauucuacuaaggcagaggucauuugaugaaggucccgguggagauucaccauaugguggaaaucaaguagagaaaaugguugguagaugcacuuucgaaccugacgaaccuagagcagcaaaagcagcauauaguuuugaauauuucucuuuauuacagaagauaaaccauauaagacuugccgaaaauggugaaacuagaccucucacacaaccucaaagacagcaauuauuauccuuagcacauaaaacuccugauaugucacuagcaagaauuagaaaagaacuagcuuugccggagacaguacaauucaacggaguaagaugccgagcuaaugaaacacucgaggaaucugagaagaaagaaaaauucgcauguuuacccgcauaucauaaaaugaggaaagccuuaggugguguaguaaaaggcaggauaucuucccucuccaucagucagagggaugcagcugccacggcuuuaaguuuguauaaaaaugaagacacacugagggcuaaguuaacagaagcaggauuucaagcacccgaaauugaugcacuagcaggguuaacagguuuuucaaaauuuggccauuuaucuuugaaagcaugccgaaaacugauaccacaucuagaacaaggacuaacauaugaucaggcuugcucggcagcaggauacgacuuuaaaggucacggagcgggugaaagagcauuuacauuaccagcagcggcucccgaaauggaacaaauuaccucuccgguagugagacgagccguagcacaaacaauaaaaguaguuaaugguauaauaagagaaauggaugcuaguccagcuuggguaagaauagaauuagcuagagaauuaucuaaaacuuuuggagaaagacaagaaauggaccgcucuaugagagaaaaugcagccaaaaaugaaagacugaugcaagaacuuagagauacauuccaucuucuuucuccaacaggccaagaccuaguaaaauacaggcuuuggaaagaacaagacggcguaugcgcauacagccuucaacgauuagauguugaacagcuuuuugaaccaggauacguagacguagaccauauaguacccuauaguuugagcuuugaugauagaagaucaaauaaaguauuaguauuaaguucagagaaucgacaaaaaggaaauagauuaccauugcaguaucuacaaggaaaaagacgagaagauuucauagucuggacaaacucuaguguacaugacuacaggaaaagacaaaaccuauuaagagagaaauuaucagaugaugaagcggaaggauuuagacaaagaaaucuacaagauacccaacauauggccagauuucuguauaauuauauaagcgaccaucuagcuuuugcacaauccgaggcccuaggaaagaaacgaguauuugcaguauccggagccgugacaagucauuuacgaaaaagauggggacucucaaaaguacgagcugauggagacuuacaucaugcauuggaugcagcuguaguugcguguacaacugaugguaugauuagacguauaagcggguauuauggacacauagaaggagaauauuuccaagacgcagacggagcugguucacagcaugcccguacaaaagaaagauucccugcaccuuggccaagauuuagagaugaacuaauaguuagacucucggaacagcccggugaaccacuacucgacauaaauccagcauuuuacugugaauauggaacagaacauauaagaccaguuuuuguaucaagaaugccaagaagaaaaguaacggguccaagccauaaagagacaguaaaaggagcagcagcagccgaugaaggacucuuaacagucagaaaggcuuugacagaacuaaaauuagauaaagacggagagauaaaagacuauuauaugccuagcagugauacuuuacuauacgaagcccucaaagcucaauuacguagauuuggaggagaugggaagaaagccuucgcagaacccuuuuacaaacccaaagcugauggaacaccuggaccguuagucaggaaagucaaaacuacugaaaaagcaaccuuaacaguaccaguacacgguggagcugcaucaaacgauacuaugguuagaauagauguauucuuuaugccaggcgacggauauuauuggguuccacuauacgucgcagauacacuuaaaccugaacuacccaaucgagccguaguagcacacaaaccauauucugaauggcaggaaaugcgugaagaagauuucguauuuagucuauauccaaaugauuuaguguacguagaacauaaaagcgaauuaaaauuuacaguacaaaacgcagacaguacauuagagaaaacuagaacgcaagcaagugcauucguguauuuuguguccgguggaauuucagguggcacaauaacaguaagaacucaugacaauuccuacggaauaccuagucuaggccuaaaaacauugaaaucauuaugcaaauaccaaguagauguauuagguaaugucuucccgguucauaaagaaacucgucaaaaauuccgauga

SEQ ID NO: 5042 - RNA, 3255 nt, Artificial Sequence
  Cas9 variant
augaaaaacacgcuauauggaauagggcucgauauaggaguagcaucagucggcugggcagucguaggucucaauggaacaggcgagccuguugguuuacaucgccuaggagugagaauauucgauaaagcagaacaaccaaagacaggagaaucauuagcagcacccagaagaauggccagagguaugagaagaagauuacgucgaaaggccuuacgacgugcagauguuuacgcuuuacuugaaaggucgggacuaucaacacgugaagaauuagcgcaaauguuugaagcaggcggcuuagaagacaucuacgcacuaagaacgcgagcauuagacgaacccguuggaaaagcagaauuuagcagaauacuuuuacauuuagcacaaagaagaggauuuaaaucaaacagaagaacagcaagugauggagaagacgggaggcuacuagcagcaguaaaugagaauagaagaagaauggcacaaggaggauggagaacaguaggagaaauguuauacagacaugaagcauucgcauuacauaaaagaaacaaagcugaugacuaccuaaguaccguagguagagauaugguagcugaagaagcaaguauucuauucgagagacaaagagcaaugggguguagcugggccgcucccgaacuacaagcugaauaccuauccauauuacuaaggcaaagaaguuuugaugaaggaccuggaggcaauagccccuauggaggaaaucagguugagaaaaugguuggaagauguacauucgaacccgacgaacccagagcagcaaaagcagcguacagcuucgaauauuuuucccuuuuacaaaaacuaaaucauauuagacuagcagaaaauggcgaaacaagaccacugacccaaccacagagacaacaauuauuaagucucgcucauaaaaccccggacauaagucuagcacgaauaagaaaagaguuagcccuaccugaaacuguacaauucaauggaguacgauguagagcaaaugagacacuugaagaaagcgagaaaaaggaaaaauuugcaugccuaccugccuaccacaaaaugcgaaaagcauuggaugguguuguaaaaggcagaauuucgaguuuaucaauaagucaacgggacgcugccgccacagcacuauccuuguacaaaaaugaagauacauuaagggcgaaacuuaccgaagcaggauuccaagcuccugaaauugaugcacuagcaggacugaccgguuuuucaaaauucggucaucuuaguuuaaaggcuuguaggaaacuaaucccacauuuagaacaaggucugacauaugaccaagcauguacagcggcaggcuaugauuuuaaaggacauggcgcaggggaaagagcuuucacuuuaccggcggcagcaccagaaauggaacaaaucacaagcccaguagugcgacgagcaguugcacaaacaauuaaaguuguaaacggaauaauacgagaaauggaugcaaguccagcauggguacgaauagaguuagcacgagaacuuucaaaaacuuucggagaacggcaagaaauggacagaucaaugagagaaaacgcagcgcaaaaugaaagguuaaugcaagagcuaagagacacuuuucauuuacugucaccaacgggucaagaucuuguaaaauauagacuauggaaagaacaagacggaguaugugcauauucauuaagaagauuggauguagaacgauuauucgagccaggauaugucgacguagaccauauaguaccauauagucuaucuuucgacgaucgaagaaguaauaaaguuuuaguacugucaagugaaaauaggcaaaaaggaaauagauuaccauugcaauaccuacaagggaaaagaagagaggacuuuauuguauggacaaauucaucaguacacgauuaucguaaacgucaaaauuuacuaagagaaaaacugucaggugacgaggcagaaggauuuagacaaagaaauuuacaagauacacaacacauggcccgauuccuuuauaacuauaucagcgaccacuuagcuuuugcacaaucagaagcacucgggaagaaacgaguguuugcagugucgggagcaguaaccagucaucuaagaaaaagauggggauuaucaaaagugagagcagauggugauuugcaucacgcauuagaugcugcagugguggcauguaccacugaugguaugauuagaaggauaaguggauauuauggacacauagaaggagaauaucuacaagacgcagauggcgcagguagccaacaugcaagaacaaaagagagauuuccagcaccauggccuagauucagagaugaauuaauaguaaggcuaucagaacaacccgcagaaccauuacuagauauaaacccagaguucuauugcgaauauggaacagaacacauacggccaguuuucguaucaagaaugccacgaagaaaaguaacaggaccuggucauaaagaaacaauaaaaggcgcugcggccgcagacgagggauuguuaacaguaagaaaagcauugacagaacuaaaauuagauaaagauggagaaauuaaagauuacuauaugccuucaucugauacacuacuuuaugaagcucugaaagcucaacuucgaagguuugggggagacgguaagaaagcauuugcagaaccauuuuauaaaccaaaagcagaugguaccccaggaccacugguccgaaaaguaaaaacaacagagaaagcaacgcuuacaguccccguacauggaggggcagcaucaaacgacacgauggucaggguagauguauuuuuagugccgggcgaugguuauuauuggguaccaguauauacagccgacacacuuaaaccagagcucccaaaucgugcaguaguucaagguaaaccuuauagugaauggaaagaaaugcgagaagaagauuuuauauuuaguuuauaucccaaugaccuaguuuacguagaacauaaaagcgguuuaaaauucaccuugcaaaaugcggacucaacauuagagaaaacaagaacacaaacaucagcguuugcguauuuuguuucaggauccauaagcacggcaucaauaacaauucguacacaugauaaugcauauggaauaccuucauuaggaguuaaaacucuaaaaaccuuucauaaauaccaaguugauguacuaggaaauguguuuccaguacauaaagaaacacgccaaaaauucagauga

SEQ ID NO: 5043 - RNA, 3255 nt, Artificial Sequence
  Cas9 variant
augagacucggacucgacauaggaacaaauucaauaggcugguggcuauaugguacagaaggagguagaauaacagaaguuguagacgguggaguaagaauauucucagauggaagagauccccaaagcaaagcaagucuagcaguugaccggagagcagcuagaucgcaaaggcggcgaagggaccgauauuuaaggagaaaggcggcacucaugaaaagaauggcacaaguagguuugaugccagcagauccagcagaagcaaaaguacucgaaguucuuaacccauaugaauugagagccagcggauuagacggaccacuaccacuaacacauuuugguagagcucuuuuccauuuaaaccaacggagaggguuuaaaagcaaccgaaaaaccgauagaggagauaaugaaucaggaaaaauuaaggaugccacagcacgacuugaucaagcaaugauggcaaagggcgcaagaacauacggugaauuucuacauaugaggagagcagccgcuuuagauccuaaaucaguuccuaguguuagaacacgguugacuguagcaaggagggacgacgcugagaaagaagaagcaggguaugauuucuauccggacaggaaacauuuaucggaagaauuugauaaauuaugggccgcgcaagcucgccacgcuccagacguucuuacagaagauuuacgcgacgaaauugcaacaauaaucuuucaccaacgaccacuuaaaacaccagaaguaggucuaugucuauuuacaggacaacacggaguaccugaacgagacaaaagaauaccgagugcacauccuuuaaaucaaagacgaauccucauggaaacaguuaacaacuuaaaaguagcagcacaaggagaaccuagcagaccacuaacaagagaagaaagggaucaaauuguacacgcacuagacaacaaaaagcacacaaaaagucuuucaggaaugacuaugaaacuaaaagcauugggaaagguuauuaaacuaaggcccgaacaaggauuuacacucgagacugcuaacagagacgcaauagcuugcgacccaguaagagcaaguuuaagucaucccgacagauucggggcgagauggaguacauuagaaucugcaggucagugggauguaguacaaagaauaagagcgguacaaagugaugcugaacaugcagauuuagucgguugguuaauggaugugcacgguuuagaucgagaucacgcggaagaaaccgcaaaugcaccucuaccagaagguuacgguagauuaggccugacagcuacuacuagaauacuagccgcccuagaagccgaugugcugaacuauucagcugcaguggcagcaugcggauggcaucauagugaugguagaacgggagaaguuuuggaaucacuaccuuacuacggggaaauacuagaaagacauguaauuccaggaacuggagaucccaaugaugaugaugugaaaagauacggucgaaucacaaauccuacuguacauauaggguuaaaucaacuaagaagacuuguaaaucgaauaauaacaguauacggacgaccugaugaaauaguggucgaacuagcuagagaucuaaaacucagugaagaucaaaagaaagauguccaaagggauaucaagaaaaacacagaagcugcaauaagacgcggaaagaaauuagaagaaaugggaguuccaaacaccggagccaacagaaugguacuaagguuaugggaagacuugggagaugacguuaugacaagaaauugcccauauacaggcaaaaggauaagcgcaggaauguuauuugacggaagcugugacguggaucauauucuaccguacucaagaacccuagaugauaguuuugcuaauaggacccucugucuaaaagaagccaauaggcagaaaacugauaaaacaccaugggaggccuggggagaaacagagcaaugggaagcaaucgcagcaaaccucaaaaaucuaccagccaauaaagccuggagguuugcaccagacgcaauggaaagauucgagggugaaaaagauuuuucagcaagagcgcuagccgacacucaauauuuaagucgaauugccagggcauaucuagacgcauuauaugauggagaugauggaaaaucccaugucuggguaguaccugguagacuaacagaaaugcucaggaggcauuggggucuaaacggaguugcugcuuuaacagauagcgauaaacaaacagucaaagcuaaaaaucgaacagaccacagacaucaugcaauugacgcugcaguaguagccgcaacugauagaggacuaauuaaaagaauagcagauauggccaaaagagaugaguuuaauggagcagaagaagucgcccggaguauaccaccaccuugggaaggauuucgugacgauguuucggcacaaguaacuagaauaauaguaagccacagagcagaucauggaagaauugacccggcagccagaaaaucaggcagagauaguacaucuggccaauuacauaacgauacagcuuaugggauagguagagacggcacagugguauccagaaaaccauuagcauccuuaucgccaaaugacauaguuguaacaaaacguggcgcuaauauacgggacguugaccugcaaaagcauuuagcaagaguuacccacgguuuagauggaaaggcauuugaagcugcucuuuuagccuuugcagcaagcccaauauuaccugauaacacugauaauccauacuucgguuuacggcgggugcgacuagaagagacguugcaagaaucugcuagaguagaaguagccgaucaagaaggaaggcccuacaaagcauauaaaggagauagcaaccauugcuaugaaauauggugccuaccagauggaaaaauaaaaccacagguuguuacuaccuacgaagcucaccaaagcggcgcagaaaagaaaccccacccagcagcaaaaaggcuuaugagaauuuuuaaacgagauaugguuaugcuagaaagggacggagaaacaauaauugguuauguacagaaaaugaaacaaaauggcagcauauuuguggcaccucacacagaagcuaaugcagacgcacgagacagggauccaaaagaugacuuuaaauuaauacaauuaggcgcggguucucuuguaaaagcaaaagcaagacgaguaauaguggacgaaaugggacgacuaagagacccaggaccacccuuauga

SEQ ID NO: 5044 - RNA, 3258 nt, Artificial Sequence
  Cas9 variant
auggauaaagggaccaacagcauagguugggcugcucugagguuagaugaacaaggagaaccgguggggauaauagaagcuggaguuaggaucuaugcagauggaagagaaccaaaguccggaacaucguuagcagagggucgaagaauagcaagagggaugucaaggagaagagaucgauacaaaagacguagaagaacuguauuaaauacauuaacagaguucggauugaugccagcaacaaaagcagcaaggaaggcauuaguggcagaaacaaaugaccgaagauucggagaaguagccaguaaugucuaugcauugagagcacgagcucuagaugaaaaauuaccucuauaccaacuagguagagcuuuauuucaucuaaaccaacgaagaggauuuaaaagcaauagaaaaacagauaaacgggauaaugaucaaggaaaaauagcaucagcaaucagcagacuagguagaaaauuagaugaagcaggcgcuaggaccuuaggagaguuccuacauaaacagcaugccgcugguaaauggguacgaguacgcccaaguagaguaccaggagaagaugacaaggaagaagauggauauggauucuacccugaaaggucauuuuuggaacgagaauuugcagcuauuugggaagcacaagcggcuuuuuacccugagcuuuuaacggaggaaagaagagaucaucuacacugggucauguucuuucaaaggccguuaaaaagaccaacgguaggaaaaugcucguuucacccagacgaggaucgacuuccaaaagcacacccacuuuuucaagaauuucgacuaauaaaagaguuaaacgaacucgaaguaguccauagaggugauagaagggaaaaacuuacaccagaucaaagagacagguuauuuaaccaauuaagaacacaaagauccagugcauuuacggcauuacguaaaacaauaaaagcaccaacagguacgagauuuaauaaagaaagugaugcaagagauaaacuuaaaggagaugaaguugcugcagaaaugucacauaaggauagguuuggucaagcguggauaggcaugccauuagcggaaagaugggcaguuguugcgauguuauuggauacagaagauccguuagaaguaaaagcauggcuugaagaaagauacggguucgcagcagacaggauagaugcuaucgcugcagcuaaauugccaacaggcuacggaagacucggagaaacagcacuacgugauauguuagacgaauuaagaaacggaacagugaaagacgacgccggacgggauguuguacuuacggaacgacaagccauggauaacauauggggugauaacccagcauuacaaagagcaguaacagaugcgagggagcuuccgcccuaccaagaaguacuaggccgaaggauaccgccuggaaccggaaaacccgcugacccuuaugacguccaaaaaggaagacugacaaauccuacaguacauauaggacuaaaccaguugaaacgaauaguaaauguauuaaugagaagacacggaaggccugaacagauagcuuuagaauuagcuagagaccugaaacucaaugaagaacaaaaagcggagaaaaaucgcgaaauagccaggaacacuaaagcagcagaagcuaggggaaagaaauuagaggaacuugggcacgcaaauaauggauauaaucguguacuacuaaaacuaugggaagacuuaaauuuaaaacaaccagaaaacagggaauguauauacugugguaaagcaaucggaauugggacacuuuuaucaaaccaaguugauauugaccauauauuaccauggagcaaaacccuagaugacucucaagcaaauagaauaguuugucauguagaauguaauagacaaaaagguaaccacgcaccagcggaaguuccacaauggcaugauagauaugacgauauuuuagcaagggcagaacgauuaccaagaaauaaagcauggcgauuuggacgugaggcaaugaagaaauuuaaagaugaugaaucuuucuuagcaagacaacuuacagauacucaguauuuaucaagauuggcccaugaauauuuaggagcguuguacccugaugaggaaccggaugagugggguggaccagcccguagaaaucaugucaggguuauacccggacguaugacugaaaugcuaagaagacaaugggguuuaaaugcaauaauuuccgaccauaaucagaaaaacagaaaugaucauaggcaucacgcaauugacgcaauuguuguaggaguaacaacacgaagauuacuacaacgaaucgcaacgguagcaggaggacgagaggcucuagcguuagaagagacaauaggaaaaauagaaccuccauggccagguuucuaugacgauguaaaagcagcuaucgacagaauagucguaucucauaaaccagaucacgguucauuaccaaaacccggaaaaccagguagaacagcgggacaacuccauaaugauacagcauauggauuuacuggugaagcacguaauggcgugccgauuaugguacaccguguaccauucgcaucuuugacagaaaaagauauaccaucgauaagagauagacaauuagcagaugcacuuuaugcggcuauaucaggaauaucaggcaaggcagaauuggcugcagcucuggcaagauucagugaaucuggcccauauaaagggauucgucaugugcgaguuguugagcccgucucagucauugcaauuaaagaccaagcaggaaaagcguacaaaggauauaaaggugaugcaaauuacagauaugauguaugggaacuaccuaauggaaaguggacgcacgaaguugugaguauguucaaugcgcaucgaccagacuggcaaucagaaauacgaaguaaaaacccugcagcaagaaaaguucuaucauuacaucaaaacgacaugguugcguacgaacacccacaagacgguuauacaauagggagaguaguaaaauuuucugcuggaggacaaauggcauuggcaggaaauagagaagggggagcucuaaaaagcagagaugcugauccagaagauagguucagauauuuuuauaaaucagggggagcaaugagagacguacaauugcgacaaguuagagucgaugaaacaggaagaguuuuugauccuggaccucaagauagagagucgaggaaugcaagaaaacaaaacgacgcaggauga

SEQ ID NO: 5045 - RNA, 3264 nt, Artificial Sequence
  Cas9 variant
augcgguacaaaauaggauuggauauaggaauaacaagcguaggcugggcagugaugaauuuagacaucccuaggauagaagauuuaggaguuagaauauuugacagagcagaaaacccccaaacaggagaaucauuagcauuaccacgaagacuggcaagauccgcgagacgacgccuaagacgaagaaaacauaggcuagaacgaauacgacgacuuguuauaagagaagguauacuaacaaaagaagaauuagauaaauuauuugaagaaaaacacgaaauagacguauggcaacuuagaguugaagcacuagaccgaaaacuaaacaacgaugaguuagccagaguccuacuacacuuagcuaaaagaagagguuucaaaaguaauaggaaaagugagagaagcaacaaagaaaauaguacaaugcuaaaacauauagaagaaaacagagccauauuaucaucauacaggacuguaggugaaaugauaguaaaagauccaaaauuugcccuacauaaaagaaauaaaggcgaaaacuacacuaauacgauagcacgcgacgaccuggaaagggaaaucagacuuauauuuagcaaacaaagagaguucggaaauaugucgugcacagaagaguucgaaaacgaauauauaacaaucugggccagucaaagacccguagcuucaaaagacgauauagaaaagaaaguaggcuuuuguacauuugaacccaaagaaaagagagcaccuaaagccaccuacaccuuccagagcuucauagcuugggaacauauaaacaaauuacguuuaauaucaccuucuggagcaagaggauuaacagaugaagaaagacgacuucucuaugaacaagcauuucaaaagaauaaaauuacauaucacgacauaagaacauuacuccaucuuccugaugauacuuacuuuaaaggaauaguauacgacagaggagaaagcagaaaacaaaacgaaaauauacgcuuccuagaauuagaugcauaccaccaaauuagaaaagccguagauaaagucuaugguaaaggcaaaucuuccucauucuuaccaauugauuuugauacauuuggcuaugccuuaacccuauucaaagacgaugcagacauacacucauaccuacgaaacgaauacgaacaaaauggcaagagaaugccuaaucuggcaaauaaaguauacgauaaugaauugauagaagaauuauugaaccuuuccuuuacuaaauuuggccaucugucccugaaagcucucagaucgauacuacccuauauggaacaaggagaaguauacagcagcgccugcgaacgagcaggguacacauuuacaggcccuaagaagaaacagaaaacaaugcuacuacccaacauaccuccaauugccaacccaguagucaugagagcucuaacacaagcucgcaaaguagucaaugcuauaauuaagaaauauggcagcccagugagcauacauauagaacuagcacgagaucuaagucaaaccuucgacgaaagaagaaaaacaaagaaagaacaagacgaaaauaggaagaaaaacgaaacagcaauaagacaauuaauggaauacggccucacacucaacccaaccggacacgacauaguaaaauuuaaauuauggagcgaacaaaauggcagaugugcuuauucauuacaacccaucgagauagaacgauuauuagaaccagguuauguugaaguagaccacguaauuccuuauucacgaucgcuagaugauagcuauacaaauaaaguacuuguacuaacaagagaaaacagagaaaaagguaaucgaauaccagcagaauauuuaggaguaggaacagaaagauggcaacaauucgagacauuuguucuaacaaacaaacaauuuaguaaaaagaaacgugacagacucuugcgucuacacuaugaugaaaacgaagaaacagaauuuaaaaacagaaaccuuaaugauacaagauauaucuccagauucuucgcaaauuuuaucagagaacaccuuaaauuugcagaaagugacgauaaacaaaaagucuauacuguuaacggaaggguaacugcacaccuucgaucaagaugggaguucaacaaaaaccgugaagaaucagaccugcaucacgcagucgaugcuguaaucguggcauguacaacaccuagcgauauagcgaaaguaacagccuuuuaucaaagacgagaacaaaacaaagaacuagcgaaaaagaaagaaccacauuuuccacaaccuuggccacauuuugcagaugaacucagggcacgacuaucaaaacauccuaaagaaaguauaaaagccuuaaacuugggcaauuacgaugaucaaaaauuagaaucauugcaaccaguauucguaaguagaaugcccaaaagaucaguaacgggggcugcacaccaagaaaccuuaagaagguacguaggcauagaugaacguucaggcaaaauucaaacaguaguuaaaacaaaacuaucagaaauaaaacuggacgcaucaggacacuuccccauguaugggaaagaaagugauccaaggaccuaugaagccauacggcaaaggcuccuagaacauaauaacgauccgaaaaaggcuuuucaagaaccuuuauauaaaccaaagaaaaacggagaaccaggaccaguaauaagaacaguaaaaaucauagauaccaaaaaucaaguuauaccauuaaaugaugguaaaacaguagcuuauaauaguaauauaguuaggguagauguuuucgagaaagacggaaaauacuacuguguacccguauacacaauggauauaaugaaaggaauccuuccaaacaaagcaauagaaccaaacaaaccuuacucagaauggaaagagaugacagaggauuauacauuuagauucucguuauauccaaaugaucucauaagaaucgaacuaccacgggagaaaacaguaaaaacagcagcaggagaagaaauuaacguaaaagauguauucguuuacuauaaaacgauagacuccgcaaacggaggccucgaauuaauuucucaugaucaccgauuuagcuuacgaggagugggaucuagaacacuaaaacgcuuugaaaaauaucaagucgacgugcuuggaaacauauacaaaguaagaggagagaaaagagucggacuugcuucuucagcacauucuaaaccaggaaaaacaauaagacccuuacaauccacaagagauuga

SEQ ID NO: 5046 - RNA, 3264 nt, Artificial Sequence
  Cas9 variant
augcucagaaugaaauacgcaaucggacuugauauuggcaucgcuucaguaggcuaugcaguguuagcccuagaccacgaagagaaccccuggggaaucauuagacuaggaaguagaauauuugauguugccgaaaauccaaaagauggagcaagucuagcucuaccucgaagagaagcaagaagcgugagacgacgucuaagacgacaccaucauagacuagaaagaauuaaaaaucuacuaauaaacaccgaguucauaacaaaagacgaacuguuacaucuuuaugauggaaacuuaucagacguauacgaacucagaguaaaagcucuagacuauuccguaacaaaugcggaacugacaaggauauuacuucaccuagcucaaagacgaggcuuuaaaagcaaucgaaaaagugacgccaaugacaaagaagcaggacaauuacuagaagcaguguccgcuaaugcaaaacgaaugcaagaaaaccauuacagaaccguaggagaaauguuuuauaaagaugacuuauucaguaaauauaaaagaaacaagggaggaacauauuuaacaacaguacaucgagacaugauagcagcagaagcucgaacaauauuagaaaaacaauucgccuuaggaaauaauauauguacccaagacuucauagauaaauaucuaucuauacuucuaagccaaagacaguuugaugaagggccuggagaaccauccccauaugccggaaaucagauagcaaauaugauaggcaaauguacuuucgaaccgaacgaauacagagcagcaaaagcauccuauucguuugaaagguucaauuuacuacaaaaaguaaaucaucuccgccuauuacuugaaggaaaaaguauagcacuagacaacgaacaaagaaagaaaauaauagcucuugcccacgacaaagcugaccuuagauacucccacauaagaaaagcccucggauuagacgaaaaaguacuauuuaacacaauaacauauaacgacgacguaagcguaauagagaaaaagacaaaauucaacuuuuuacaggcuuaucaccaaauaaagaaaguucuagcugaagauaugcaaaaauuaacaaccgaacaacuggacaauauaggacaaauacuaucaacauauaaaagugacaauaaacgaaccgaagaauuaucggcacucggccuugagaagaaaauaauagacgcauuacuaggaauaaauggacuaaguaaauucgcacaucuaucacuaaaagcauugagaaagauaaauccauaucuagaagaaggaaagaucuauaacgaagcguguacagccgcuggauaugauuuuaaagcccaugcaaacacucagaaaacagaacuacuccccgcauacaaagaagaaauggaugacauaaccucacccguagcuaggagggcgaucgcacaauccauaaaagugauuaacgcgauaauaagagaacaaaaaggcaguccacuguacauaaacauagaacuagcaagagaaauggcaaaaggcuucgacgaaagaacccaaauagacaaagcaaacaaagaaaaccaagccaaaaacgaaagaauaauggaaagaauaagaaccgaguuccauaaagccaacccuacaggcauggacuuaauuaaacuaaaauugugggaagaacaagacggcagaaguccauacagucaaaaagcaauuaguauaaacagauuauuugaaccaggauauguugauauagaucacauaguaccauacaguaucucauuugacgacucauuuaaaaacaaaguauuagucuuuucagaugaaaaucgagacaaaggaaaccgacuaccuauagcguacuuacaaucaaaauuuggcgcaaaagcggcagaaaauuucaugauauggguucaaagcaacauaaaagauuauaaaaagagacaaaaacuucucaaaagagagauaacagaagaagauauaaauaaauuuaaagaaaggaaccuccaagauaccaaaacaaucagcagauucuuauauaauuauauaaacgauuaccuccuauucgcacccucugacaccggcaaaaagaaacgaguaacagcaguaaacggaacaaucaccgcauaucuacgaaaacgaugggggauaaauaaaaucagggcuaauggagauaaacaucaugccguagacgccguagugauagcuugcacaacagacaaaaugauuaaagacuuaaguagcuuuagucgauaucaugaacuagaguauacgcacacagacacugaaaguuuccuuguaaacaguuuaacaggagaaauucuaaaaagguuuccauacccgugggaagacuuuagaccugaauuaauggcccggcuaucagauaauccagcagacgccuuaagaaagcugaauuuaauauuuuaucacggaaucgaccuaucaacgauaaagcccaucuuuguaucaagaaugccccgucacaaaguuacgggagccgcccacaaagcuacuauuaaaucagcuagaugcuuagacaauggcaucgucauaugcaaaacaucucuacaaaaucuaaaacuagacaaggaaggcgaaaucgcaaauuauuaugcacccgaaagcgauacgauucuauauaaugcauuaaaagaaagauuaagaagcuacgauaauaaaccagcaaaagcauucgcugagccauucuauaaaccuaaagccgauggaacuccaggacccuuaguaaagaaaguaaaagucuaugaaaaaucaacucuuaaugucgcaguacaacaaaacacagcagucgcagacaacgauuccauggugcgagucgacguauuccacguuaaagguaacggauacuaccuaguacccauauauauagcagacacgcugaagaaagaacucccaaacaaagcaauaguagcauauaaaccauaugcugacuggcccguaauggacgacaguaauuucauauuuagccuuuaucccaaugaucuaauuaaauuugagcacaaaaauaguguaaaauucgcaaaaguuaauaaagaaagcacacuaaaugauuucuacuccacaaaaucagaaauaguguauuucaaagguugcaacauaaacacuggugcuaucacaaucauaaaucaugagaauacauauguuguaucaucccuuggagucaaaacccuaccaagucuggaaaaauaucaagcagauguauuaggaaauuacacaaaaguuaagaaagaagucagaaaaccuuuccgauga

SEQ ID NO: 5047 - RNA, 3264 nt, Artificial Sequence
  Cas9 variant
augagauauaaaauaggauuagacaucggaaucacaaguguggggugggccgucaucaaucuagacauaccaagaauagaagaccuaggaguaagaauauucgaucgagcugaaaauccacaaacaggggaaucacucgcacuuccaagaagacucgcccguucagcacgaagaagacucagaagacgaaaacaucgauuagaacgaauacguagauuaaucauaagggaaggaauacugacaaaagaagaauuagauaaacuauuugaagaaaaacacgaaauagaugucuggcaauuaagaguagaagcguuagaucgaaaauugaauaacgaugaauuagcaagaguacuauuacaccuagcuaaaaggagaggauucaaaaguaauagaaaaucagaaagaucuaacaaagaaaacuccacaauguuaaaacauauagaggaaaacagagcaauccuuuccucauauaggacagucggagaaaugauagucaaagacccaaaauucgcucuacauaaaagaaacaaaggagaaaacuauacaaacaccauugcccgagaugauuuggagagagaaauccggcuaauauucaguaaacagagggaguucggcaauaugagcuguaccgaggaguucgaaaacgaauauaucgcaauaugggcaucacaacgcccuguagcgaguaaagacgauaucgaaaagaaaguuggauuuuguacauuugaaccuaaagaaaaacgagcaccaaaagcaaccuacacuuuccagagcuucauugcaugggaacacauuaacaaacuccgauuaauaagcccaagcggaacucgagguuuaacagaugaagaaaggcgauuacuauacgaacaagcauuucagaaaaauaaaauaacauaccaugacauaagaacacuauuacauuuaccagacgauacauauuuuaaaggaauaguauacgaucgcggugaaucaagaaaacaaaaugaaaacauacgauuuuuggaauuagaugccuaccaccaaaucaggaaagcaguagauaaaguauauggaaaaggcaaauccucauccuucuuaccaauugauuuugacacauucggcuacgcucucacacuauucaaagaugacgcagacauacguuccuaucugcgaaacgaauacgaacaaaauggcaaaagaaugccaaaucuagcaaacaaaguuuacgacaacgaguuaauagaagaauuacuaaaucuuucuuucacaaaauucggacaccugagcuuaaaagcauuaagaucaauacuuccuuacauggaacaaggagaaguauacucauccgcaugcgaaagagccggcuauacauuuacagggcccaaaaagaaacagaaaacuaugcugcuuccaaauauucccccaauugccaauccaguuguaaugcgggccuuaacacaagcaagaaaagucguaaacgcaauaauaaagaaauacggaaguccaguaaguauacacaucgagcuagccagagauuuaagccaaacauucgaugaacggaggaaaacaaagaaagaacaagaugaaaacagaaagaaaaaugaaacugcaauaagacaacucauggaauacggccuaaccuuaaaccccacuggucaugauauaguuaaauuuaaauuauggucagaacaaaacggcagaugugcuuacucauuacaaccaauagaaauugagagacucuuagaaccaggauacacagaaguagaucauguaaucccauauucaaggucauuagacgacucauauacuaauaaaguauuaguacucaccaaagaaaaccgcgagaaagguaaucgaauacccgcggaauaccuagguguaggcacagaacgauggcaacaauucgagacuuucguucucacaaacaaacaauucaguaaaaagaaacgugacagauuauuaagacugcacuaugacgaaaacgaagaaacugaauuuaaaaauaggaacuuaaacgauacuagauacaucucuagguuuuucgcuaacuucauuagagaacauuuaaaauuugcugaaucugaugacaaacaaaaagucuacacugugaauggccgagucacggcccaucuacgcucacgcugggaauuuaacaaaaauagagaagaaagcgaucuccaucacgcgguagacgcaguaauagucgcuuguaccacgccaucagauauagcaaaaguuacugcuuuuuaccaaagaagggaacaaaacaaagaacuagcuaagaaaacugaaccacauuucccacaaccauggccacacuuugcugacgaacuccgagcgagacucucaaaacacccgaaagaauccaucaaagcucucaaucuaggaaacuaugacgaucaaaaauuagaaaguuuacaaccaguauucguauccagaaugccuaaaagaucaguaacaggcgccgcccaccaagaaacauuacgcagauauguagguauugaugaaagaucagguaaaauucaaaccguugucaaaacaaaauuauccgaaaucaaacuagaugcaucaggacauuuuccaauguauggaaaagaaucagauccuagaacguaugaagccauaagacaaagacuacuagaacacaauaaugaccccaagaaagcauuucaagaaccacuauacaaaccaaagaaaaacggagaaccagggccuguaaucagaacagucaaaauaauagacaccaaaaaccaaguuauuccauuaaacgaugggaaaacaguagccuauaauucaaauauaguacgagucgauguauucgaaaaagacggaaaauauuacugcguuccgguauauacaauggacauaaugaaaggaaucuuacccaacaaagcuauugaaccaaauaaaccauacuccgaauggaaagaaaugacagaagacuacacauuccgauuuagucuauacccaaacgaucuuauaagaaucgaauuaccaagagagaaaauaaucaaaaccgcaggcggggaagaaauaaaaauaaaagaucuauucgcauauuacaaaaccauucacucaggcacagcaggccuagaauuaguuagccaugacugcaguuuuucacucagugguguaggcagucgcacacuaaaacgguucgaaaaauaccaagucgauguccuagggaauauuuauaaaguacgcggcgaaaaacgcgucggacuugcaaguagcgcccauucgaaaacaggagaaacaauccgaccacuucaaagcacuagggauuga

SEQ ID NO: 5048 - RNA, 3264 nt, Artificial Sequence
  Cas9 variant
augcgauauaaaauaggacuagacauagguauaacaucugucggcugggcuguaauuaaucuugauuuaccuagaauagaggaccuagguguccguauauuugaccgagcugaaaacccucaaacgggagaaaguuuagcauuaccaagaagacucgccagaucugcaagacguagacuuagacgacguagacacagacuagaaagaauaagaagacuccucacgagggaaaauguguuaacacaagaagaacuugacaaacuauuugaaaaaaaacacgaaauagacguuuggcaacuucgcguagaagcauuggauagaaaacuuaauaaugacgaauuagcuagggugcucuuacaucuagcgaaaaggagagguuucaaaucaaauagaaagucagaaagaagcaauaaagaaaacagcacuauguuaaaacacauagaagagaaucgauccauauuaacaggauaccguacugugggagaaaugauaguaagggacccaaaauucgugcuacauaaaagaaacaaaggcgagaacuauacuaauaccauugcaagagacgaccuagaacgagaaauacaacuaaucuuugcucgccagcgugaauuugguaauaugauauguacggaggcauucgaaaacgaauauauagcaauauggaguagucaaagacccgucgcaucuaaagaugauauagaaaaaaaaguaggauuuugcacuuuugaaccaaaagaaaaacgagcucccaaagcaaccuacacauuucaaucauuuauagcaugggaacacaucaauaaacuacgacuaguaaguccaagcggcacacgcgaacuaaccgacgaagaaagacgguuacuuuaugagcaagcguuccaaaaaaauaaacuaaccuaccacgacaucagaacccuccuacaucuaccagacgacacauacuucaaagguaucguguacgauuggggagaaccucugaagcaaaacgaaaauauaagauucuuagaauuggaugcauaucaccagauacguaaaacaguagacaaaguguacggccgcggaaaaucuagcucauuucuaccuauagauuuugauacuuucggauacgcacuaacuuuauuuaaagacgaugcacauauacguucauaccuaaggaaugaauaugagcaaaacggcaaaagaauagcaaaccuggccaacaaaguauacgacaaugaacuaauagaagaacuccuaaaucuaucauuuacaaaauucggccauuuaaguuugaaagcacuaagaaacauauugccauauauggagcaaggcgaaguauauaguucugcaugcgaaagagcaggauauaccuucacaggaccuacuaaaaaacaaaaaacuguccuucuaccuacaauaccacccaucgcaaacccggucguaaugcgcgcacuaacacaagcaagaaaagugguaaaugcaauaaucaaaaaauaugguucuccaguaaguauccauauagaauuagcacgugacuuaucacaaacauucgaugaaaggaaaaaaacaaaaaaagaacaagacgagaauaggaaaagaaaugaaacagcgauaagacaacugauagaauauggacuaacacgcaauccaacaggacacgauaucguaaaauuuaaacuauggagcgaacaaaauggaaggugugcuuauucacuacaacccauugaaauaaaaagacuauuagaaccaggcuacguggagguugaucacguaauaccuuauucacgaucacuggaugauucauacaccaauaaagugcucguacuuacaaaagaaaacagagaaaaaggaaaccguauaccugcagaguaucuaggagugggcacagaaagauggcaacaauucgaaacauuuguccugacaaacaaacaauucaguaagaaaaaacgagauagauuacuacgguuacacuaugaugaaaacgaagaagcugaauggaaaaacagaagccucaacgacacuagguacauaucaagauuuuuugcuaauuucauaagggaacacuuaaaauuugcugauucagacgacaaacaaaagguauacacuguuaacggcggagucacagcacaccuacgauccagaugggacuucaauaaaaacagggaagaaagcgauuuacaucacgccguagaugcugcuauaguagcuugcacaacgcuaucugauauugcaagagugacggcauucuaccaacgaagagaacaagcuaaagagcuagcgaaaaaaacagaaccacacuuuccacaaccauggccacacuucgcagacgagcuaagggcacgguuaucgaaaaacccaaaagagucaauaaaagcacuaaaccuaggcaauuacgacaacgaaaaacuugaauccuugcaaccaguguuuguaaguagaaugccaaaaagaagcguaacaggagcagcucaccaagaaacucuaaggagguacauuggaauagaugaaagaagugguaaaauucaaacgguuguaaaaacuaaauuaagugaaaucaagcuagaugcaucuggacauuucccaauguauggaaaagaauccgauccaagaaccuaugaagcaauaagauuacgccuacuagaacacaacaacgaucccagaaaagcauuccaggaaccauuauauaagccaaaaaaaaacggagaacuuggaccuauaauucguacaguaaaaauaauugauacaaaaaaucaaguaauacccuuaaacgauggcaaaacgguugcauauaacagcaauauagugcgcguagauguguucgaaaaagaugggaaauacuacugugugcccguauauacaauggacauuaugaaaaaaguccugcccaauaaagcaauagaaccaaauaaaccauacucggaauggaaagaaaugacggaagacuacacauuccgauuuucauuauacccuaaugauuuaauaagaauagaauuaccaagagaaaaaacaguaaaaacaacagcagggcaugaaauaaauauuaaagacguauuuguuuauuacaaaacgaucgacucagcaacaggaggccuagaacucauuagucacgacaauucguucagcuuaagagguaucggcucccgcacauuaaaacgauucgaaaaauaccaggucgauguauuaggaaauaucuacaaaguccgaggugaaaaaagagugggacuugcgucuuccgcacauccggagacaagagaaacuauuagaccauuacaauccacacgagauuga

SEQ ID NO: 5049 - RNA, 3264 nt, Artificial Sequence
  Cas9 variant
augaaaaaacuaguccuaggccuggauauagguguagcaucaguaggcugggggaucaucgacgcagaaaauggagacguuguagacacaggagucaggcuauucaguucaagagacgcguccgaaaaugaauccagaagaacaagccgacaauccagacgacuuucgcgaagaaaaaaacacaggagggaaagaauaaaacaauuacuccuggcccaugacauggacauaugcgacauaguaaacgaaaacccauacgaacuccgaguaaaaggccuuaacgaaaaacuagaaguaucagaaaucuacguagcacuaacccaccuggcuaagcgaagaggcgucaguuaucucgacgaugucguggaagaggguggaacaauaaaaagcgaacacuuaaacaaaaauauggaagaaauaaaauccggcaagaugccuugugaaauacaacuagaacgauuugaaaaauauggacaaguuagaggaaugauagaaauaaaccaagacacugaagaaucaucauuccuaguaaacauauucagaacaucagacuauauuaaagaagcuaaaacaauccuagcaacacaacaaaaauuucacaaacaaaucaccaaugaauucauugacgaauauauccacauuauggccucaaaaagagacuacuucauagguccaggaaacgaaaaaagccgaacagacuacggaguguacagaacuaacggcgacacaugggacaacuuauucgaaauuuuaauaggaaaauguucaguauucccagaagaaacuagagcugcuagaaguaguuauguagcucaagaauuuaaucugcuaaacgauuuaaacaaccuaaaaauaucgaaucucgaaaguggaaaacuaucugccagucaaaaacacgacauaguagaaaaaguaaaaaacucuaaaaaauucggaacaaaagaucuucuaaaauacauugccucaguaugcgaaugcaaaauagaagauauagguggcugccgcguugacaaaaauagaaaaccaauaaugcauaccuuugaaaauuacagaaaaguucauaacgcacuuaacgaagcaggcgucgacuuaagacuauccgaaacagauuacgacgaauugaugaaaauuaugacccuuaacagugagaccuuagaaauaaaaaagcaauguaaagaaaagcuaccacaacuaacagaagauuauuuaaacguguguuuggucuuaaauaaaaaaggcgccuucagcggcuggcacgcgcuaucuuugaaagcaaugaaauuaaugaugccugaauuauacggaacgucaaaaaaccaaaugcaaauaauacacacaaugcaguuagggaaagccuaucuaaaaccccucaaucaacaaaaauaccuaaauucagaggccauauuagaggaaauauacaacccaauugcugcaagaucaauaaggcaaacaauaaaaguuacaaaugcaauacuaaaaaaauauggacaucuagacagcguuauaauagaaaugccucgagauuaucaaaccagugaagacgaacgaaaaaugauagaaaaaaugcaaaaagaaaacgaaaaagaaaagaaagcggcucugaaaagagcgagagaggaguauccauuuccagacgaagcauuuagaaaucacaaagaacucgcuaccaaauuaagacuuugguaccaacaggaucaauucuguguuuauucuggacgaaaaauuuccguugucgaccucguaagaaacccaaaucaauucgaaauugaucacauaauaccucaaaguguauccuuagacgauaguuuaaacaacaaaguauuaugcuuuagugaagaaaaccaaaagaaaggacaacaaacaccuuuuuauuaccacaagggcaaaagcgguaacuggacguacgaacaauacaaacuauucguagaaaaacuauucgauaaaaaaaaaauaaguaacaaaaaaagagaauuacuucuauucgaagaagacauaaauaaaugggauguaagaaggggauuuauagcacgaaacuuaguugacacacgauacgcaucaagagugauacucaacagcuaccaacaauauuucggaaaucaugaaaugggaacaaaagucaaagucguuagagguaaauuuacgucccaacuuagaaaaaaauggagaaucuucaaagauagaaaugaaagccacucacaccacgcaauugacgcccuaauaguagcugcaacagcuaaccuaagacuauggaaaaaaaauacacuagguguaagcgacgaaggcaaaguuuacgauaaggaaacaggagaaauuuuaccauucgaaaaacuaacugaaagugaauauaacgaaaugaugaacaaagaaccauaccuaaauuuuaaaaccaaacuucaaaauauagaaacaaaaguaaaauauagcuacagaguaucaaaaaaaguaaauagaaaaaucucagaugccacaauuuauaguacacgagaaagagauggcaucgacuauauaguaggaaaaauaaaaaacauuuaugacguaaaaaccuacaaagaccaauuccuaaaacgcuacaaaaaaaacaaagagcaauucuugauguaucaacaugauccacaaacuuucgcaauacucgaaaauauuauggcgacauaccaggacgcagaaaacccauucuuagcauacaaaaaggaauacgggguuauaaggaaauacuccaaaaaagguggggguucuccaguaaccucacucaaauuuauagacaaaguacuaggacaaaaaauagaucucaccgcaaaaaaccaggccgcauuaccuaaaaacaaaaaaguaguauuacaaucaauaacaccauacagagcagacguauacuaugacgaaauugacaagagauaccaccuaauaggaguuaaauacucacuguuuuccuuuucgaaacaagguuacguaaucaacccuauugcguaccaaaaauuguuagagaaagaacaaauacacucagagaugaaauuuuguuucagcuuauacagagaagacauaauagaauuuggugaagacccagacucccucacaagauacagguuuuggucuaaaaacgagagcggcaaaaacaaaauagaaguaaaaccuaucgaaaaaccgaauuuugagaaacaaacaguacucaccaucacuaaaaaaaucaaaaucuugaacaaauaccaaacagaugucuuagggaacucuuuuaaagcucaagaagaaaaagacccaagaaauaucgaauga

SEQ ID NO: 5050 - RNA, 3264 nt, Artificial Sequence
  Cas9 variant
augagguauaaaauaggauuagauaucggcauaaccucaguggguugggcuguaaugaacuuagacauacccagaauagaagaccuagggguaagaauuuucgacagggcugaaaauccacaaaccggggaaucccuagcacuaccccgaagacuagcaagaucagcacgcagaagacugagacgacguaaacauagauuggaaagaauaagaagauuagucauaagagaaggaauacugacuaaagaagaauuagacaaacucuucgaagaaaaacaugaaaucgacguauggcaacuaaggguugaagcccucgaccguaaacuuaauaaugaugaacuagcaagagugcuauuacaucuagcuaaacgacgaggauucaaaaguaacagaaaaagcgaaagaagcaauaaagaaaacucaacaauguuaaaacacauagaagaaaauagagcuauacuuucauccuacagaacuguaggagaaaugauaguaaaagauccuaaauucgcuuuacacaaaagaaacaaaggagaaaauuacacaaauacaauagcacgagaugauuuagaaagagaaauaagacuuaucuucaguaaacaacgagaauuuggaaacaugucuugcacagaagaguuugaaaaugaauauauaacuauaugggccucucaaagaccagucgcuucaaaagaugacauugaaaagaaaguaggauucuguacauucgaaccuaaagagaaacgagccccaaaagcaaccuacaccuuccaauccuucauagcuugggaacacaucaauaaauuacgacuaauaucaccgagcggagcuagaggucuaacagacgaagaacgacgguuacuauacgaacaagcauuucagaaaaauaaaauaaccuaucacgacaucaggacuuuauuacacuuacccgacgauacauauuuuaagggaauaguuuacgauagaggcgaaucaagaaaacaaaaugaaaacauacgauuccucgaauuagacgcguaccaccaaauucggaaagcaguagauaaaguuuacggcaaagguaaaagcuccagcuuucuaccaauugauuucgacaccuucggauacgcucucacacuguucaaagacgacgccgauauucauucuuauuuaagaaacgaauaugaacaaaacggaaaacgaaugccaaaccuagcaaauaaagucuaugauaacgaacuaauagaggaacuucuaaaucugaguuucacaaaauuuggacacuuaagucuaaaggcuuuaagaucaauauuaccguacauggaacaaggagaagucuacucuucggcaugugaacgcgccggauauacauuuacgggcccaaagaagaaacagaaaacuauguuauuaccaaauauaccuccaaucgcuaacccaguagucaugagagcccuaacgcaagcacguaaaguaguaaaugcuauaauuaagaaauacggcucaccaguaucaauucauauugaacucgcacgugaucucucacaaacuuucgacgaaagaaggaaaacuaagaaagaacaagacgaaaacagaaagaaaaaugaaacagcaauccgucaauuaauggaauauggauugacucuaaauccuacaggacaugacauaguaaaauucaaacuaugguccgagcaaaauggaagaugugcguauuccuugcaaccgauugaaauagaacggcuccuagaaccaggauacguagaaguagaucacgucauaccuuacaguagaucuuuagacgacagcuauacaaauaaagugcuugucuuaacaagagaaaauagagaaaaagggaaccgaauaccugccgaauauuuaggaguuggaacugagagauggcagcaauucgaaacuuuuguauuaacaaacaaacaguucucuaaaaagaaaagagauagacuacuaagauuacacuacgacgaaaaugaagaaacagaguucaaaaacagaaauuugaacgauacaagauauauuucaagauucuuugccaacuuuauuagagaacaccuaaaauucgcagaaucagaugauaaacaaaaaguguacacagucaacggacgaguaacugcccaucucagauccagaugggaauuuaauaaaaaccgagaagagagcgaucuucaccacgcaguggacgccgcaauaguggcaugcaccacucccucagacauagcaaaaguaacugcguucuaccaacgacgagaacaaaacaaagaauuagcaaagaaaacggaaccacacuucccacaacccuggccccacuuugcugacgaauuaagagcaagacuuucaaaacauccaaaagaaagcauaaaagcacuuaaccuuggaaacuacgaugaccaaaaacucgagagcuuacagccaguauuuguaucaaggaugcccaaaagaucaguaacuggagcagcacaccaagaaacauuacgaagauauguaggcauagacgaacgaaguggaaaaauccaaacagugguaaaaacaaaacugucugaaauaaaacuagacgcuagcggucacuucccuauguacgguaaagaaucugacccaagaacauacgaagcgauaagacaaagauuacuagaacacaauaaugaccccaagaaagccuuucaagaaccauuauauaaaccgaagaaaaauggagaaccagguccaguuauucgaacgguaaaaauaauagauacuaaaaaucaagucauuccauuaaaugauggcaaaacaguagcauauaauagcaauaucguaagagucgauguauucgaaaaagacggcaaauauuauugcguuccaguauacaccauggacauaaugaaaggaauacuaccaaacaaagcaauugaaccaaauaaaccauauagcgaauggaaagagaugacagaagacuacaccuuuagauuuucccucuaccccaaugaccuuauaagaaucgaauuaccacgagagaaaacagucaaaacagcagccggugaagaaaucaacguaaaagauguuuucguauauuacaaaacuauagauucagcaaacggaggauuagaacuaaucucccacgaccauagauucucacuaagaggaguaggaucuagaacgcuaaaaagauuugaaaaauaucaaguagauguccucgguaacauuuacaaaguacgcggagagaaaaggguaggacuugcaucuucagcacacagcaaaaccggugaaacagugagaccccuacaauccacacgcgacuga

SEQ ID NO: 5051 - RNA, 3264 nt, Artificial Sequence
  Cas9 variant
augagauauaaaauaggauuagauauagguauaacaucaguagguugggcagucaugaaccuagacauacccagaauugaagauuuaggcguaagaauauuugaccgagcagaaaauccccaaacaggggaaucuuuagccuuacccagacgauuagcuagauccgccagaagaagacuucgaagacgaaaacauagacuagaacgaaucaggcgucuagucauccgagaaggaauacuuacaaaagaagaguuggauaaacuuuucgaagaaaaacacgaaauagacgucuggcaauuaagagucgaagcucucgauaggaaacugaacaaugacgaauuagcacgaguacuacuacaucuagcaaaaagacgagguuuuaaaucuaaucguaaaucagaaagauccaauaaagaaaacaguacaaugcuaaaacacauagaagaaaaccgagcuauacuaucaaguuauagaacgguaggugaaaugauagucaaagauccaaaauuugccuuacacaaaagaaacaaaggggaaaauuauacaaacacaaucgcuagagaugaucuagaacgagaaauaagauugauauucucaaaacaaagagaauuuggaaacaugagcugcacagaagaauuugaaaacgaauauauaacuaucugggccagccaaagaccagucgcauccaaagacgacaucgaaaagaagguuggauucugcacauucgaaccaaaagagaaaagagcaccuaaagcaacuuauaccuuucaaucauuuauagcuugggaacacauaaacaaauuaaggcucauaagcccauccggugcacgcggacucacagaugaagaacgcagacuacucuaugaacaagccuuccagaaaaauaaaauaacauaccacgacaucagaacguuacuacacuuaccagaugauaccuauuuuaaaggaauaguuuaugacagaggagaauccagaaagcaaaacgaaaauaucagauuucucgaauuagacgcauaccaccaaauaagaaaagcaguagacaaaguauacggaaaaggcaaaagcagcuccuuuuuaccaauagacuucgacacguuuggauaugcucuaacuuuauuuaaagacgacgcagauauacacucuuacuugcgaaacgaauaugaacaaaauggaaaaagaaugccaaaucuggcuaacaaaguauacgauaacgaauuaaucgaagaacuauuaaaccucucauucacaaaauuuggacaccuuagucuuaaagcacuuagaucaauauugccauacauggaacaaggagaagucuacucuucagcaugugaacgagcaggauacacauucacagguccaaagaagaaacagaaaacuaugcuacucccaaacauaccaccgauagcaaacccaguaguuaugagagcacuaacucaagcucgaaaaguaguaaaugcaauaauuaagaaauacggaagcccaguauccauacauauagaacuagcaagagaccugagccaaacauucgacgaacgccgaaaaacaaagaaagaacaagaugaaaauaggaagaaaaacgaaacagcuauccgacaauuaauggaauacggcuuaacuuuaaauccuaccggucacgauauagucaaauucaaacuuugguccgaacaaaauggacgaugcgcauauucccuacaaccuauagaaauagaacgacucuuggaaccagguuauguagaaguugaccauguaaucccauacagcagaucauuagaugacuccuacaccaauaaaguccuaguauuaacucgcgaaaacagagaaaaaggaaacagaauaccagccgaauacuuggguguaggaacugaacgauggcaacaauuugaaacauucguacucacuaauaaacaauucucaaagaagaaaagagaucgcuuacuucgccuacauuaugacgaaaaugaggaaaccgaauuuaaaaaucgaaaucuaaaugauacaagauacauaucacguuucuuugcuaacuuuauaagagaacaccuaaaauucgccgaaagcgacgauaaacaaaaaguauacacaguaaaugguagagucacagcucacuuaagaagucgaugggaguucaauaaaaaucgagaagaaagugaccuacaucacgcaguagacgcaguaauagucgcuuguacuaccccaagugauauagcaaaaguaacagcuuucuaucaaagaagagaacagaauaaagaacucgcaaagaaaacagaaccccauuuuccacaaccauggccgcacuuugcagacgaacuaagggcaagacuaucaaaacauccaaaagaaucuauaaaagcacuaaaccuaggaaauuacgacgaucaaaaacuagaaucauuacaaccaguguucgucucaagaaugccuaaaagaucugucaccggugccgcacaucaagaaacacuaagaagauacguaggaauugacgaaagaagcggaaaaauucaaaccguaguuaaaacgaaauugagcgaaauuaaauuggacgcuagcgggcacuuucccauguacggcaaagaauccgacccucgaacuuacgaagcuauuagacaaagacugcuggaacauaacaaugaccccaagaaagcauuucaagaaccacuauacaaaccgaagaaaaauggagaaccaggaccaguaauaagaacggugaaaauaauagacaccaaaaaucaggucaucccauuaaaugauggaaaaacaguagcauauaacucaaauaucguaagaguagauguauuugaaaaagacggaaaauacuacugcguaccuguuuauacaauggauauaaugaaaggaaucuuaccaaacaaagcaaucgagccaaacaaacccuacucagaauggaaagaaaugacagaagauuacacuuucagauucagccucuauccaaaugaccuaauaagaauagagcuacccagggagaaaaccgugaaaacggcagcaggagaagaaauuaaugucaaagacgucuucguuuacuacaaaacaaucgacagcgcaaacgguggccuagaauuaauaucacacgaucaccgauuuucacuuagaggaguaggaagccguacacuaaaacgauuugaaaaauaucaaguggacguacucggaaacauauacaaaguacgcggagagaaaagaguaggacuagcaucaucugcucauucuaaaccaggaaaaacaauucgaccucuccaaucuacgagggauuga

SEQ ID NO: 5052 - RNA, 3264 nt, Artificial Sequence
  Cas9 variant
augcgauauaaaauaggacucgauauagguauaacaagcguagggugggcaguaauaaauuuagacauaccgaggaucgaagacuuagggguacgcauauuugacagagccgaaaauccgcagaccggcgaaucgcuagcacuuccaaggagacuagcuagaucugcaagacgaagacuacgaagaagaaaacacagacuagaaagaauacgaaggcuaauaauacgcgaaggaauauuaaccaaagaagaauuagauaaacucuuugaagaaaaacaugaaauagauguguggcaacuaagagucgaggcuuuagauaggaaauuaaauaacgaugaacuagcacgagucuuauuacauuuagccaaaagaaggggauuuaaaaguaacagaaaaucagaaagaaguaacaaagaaaauuccacuaugcuaaaacauaucgaagaaaauagagccaucuuauccgguuacagaacuguaggugaaaugauaguaaaagauccaaaauuugccuuacauaaaagaaauaaaggagaaaauuacacaaauacaauagcaagggaugaucuagaacaugagauaagauuaauauucucuaaacaacgcgaauuuggaaacaugucaugcacggaaaaauucgaaaaugaauauauuacaauaugggcaucgcagagaccaguagccaguaaagaugacauagagaaaaaggucggauucuguacuuucgaaccgaaggaaaaacgugcgccuaaagcuaccuacacuuuucagagcuucauagcaugggaacacauuaauaagcuaagauuaauauucccaucaggcgcaagaggacuaacagacgaagaaagaaggcuauuauaugaacaagcauuccaaaagaauaaaauaacguaccaugauaucagaacgcuacuacauuuaccagaugacacuuacuucaaagguauaguauaugauagaggagaaucuagaaaacaaaaugaaaauauaagguuccuagaauuagacgcauaucaucaaauacgaaaggccguggacaaaguauacggcaaaggaaaaucaagcaguuuucuuccaaucgauuuugacacauuugguuaugcauuaacucucuuuaaagaugacgcugacauacauucuuaccuaagaaaugaauacgaacaaaauggaaaaaggaugccgaauuuagccaauaaaguauaugacaaugaauuaaucgaagaacuauuaaauuuauccuucacuaaguuuggacauuuaagucuaaaagcacuaaggaguauucuacccuacauggaacagggagagguguacagcucagcgugugaaagagcaggauauacguuuaccggcccuaaaaagaaacaaaagacaaugcuacuaccaaauauaccaccaauugcaaacccagugguaaugagagccuuaacacaagcaaggaaaguaguaaacgcaauaaucaagaaauaugguagcccaguaagcauacauauagaacuagcacgagaccuaucacaaaccuuugaugaacgucguaaaacaaagaaagaacaagaugaaaaucguaagaaaaacgagacugccauaaggcaacuaauggaauauggguuaacguugaacccaacaggacaugauauaguaaaauucaaacuguggucagaacaaaauggacgaugugcuuauaguuuacaaccaaucgaaauagaaaggcuauuagagccuggcuauguagaagucgaccacguaauaccauauagcaggucacuagaugacaguuacacuaauaaaguccuaguccuaacaagagaaaaucgagaaaaaggaaacagaauaccagcugaguaccugggaguaggaacagaaagguggcagcaauuugaaacauuugucuugacaaacaaacaauuuucaaagaagaaaagagauaggcuauuaagacuacacuacgacgaaaaugaagaaacagaauuuaaaaaucguaaccuaaaugacaccagauauauaucaagauucuuugccaauuucauacgugaacaccugaaauuugcugagagcgaugacaaacaaaaaguuuauaccguaaacggacgaguaacaagccaccuuaggucaagaugggauuuuaacaaaaaucgagaagaaucggaccuucaucacgcuguggaugcagcaauaguagcauguacuacaccuucagacauagcaaaaguaacagcuuuuuaucaaagaagggaacaaaauaaagaacucgccaagaaaacagaaccacauuuuccacaaccauggccacauuuugcagacgaacuacgcgcacggcuuaguaaacacccaaaagaaucaauuaaagcacuaaaccuuggaaacuaugaugaccagaaacuagagagccuccaacccguauuugugucaagaaugccuaaaagaagugugacuggagccgcacaucaagaaacacuacgacgauacauugggaucgacgaacgaucaggcaaaauacaaacaguaguaaaaacuaaauuaagugagauaaaacuagaugccagcggacauuuuccaauguacgguaaagaaucugacccaaggaccuacgaagcuauaagacagagauuacuagaacauaauaaugacccuaagaaagcauuucaagaaccgcuguauaaacccaagaaaaauggagaaccuggaccgauaauaagaacagucaaaauaaucgauacuaaaaaccaaguaauaccacuuaaugacggaaaaacaguugcguacaauucuaauauagugagaguugauguauuugaaaaagacggaaaauauuauuguguaccaguuuauacuauggacauaaugaaagguauacugccaaauaaagcaauugaaccuaauaaaccauacagcgaauggaaagaaaugaccgaagauuacacauuucgauuuagucuauaccccaacgaccuaauaagaauagaacuaccaagggagaaaacaguuaaaaccaccaccggagaagaaauaaacguaaaagacgucuuuguauauuauaaaaccauagauucagcaacagggggacucgaauuaauaagucaugauaaccgcuuuagucuuagagguguaggauccagaacauuaaaaagauucgaaaaauaucaagucgacguacuaggaaacauauacaaaguaagaggagagaaaagaguaggacuugcaucaagugcucacuccaaaacaggugaaacaauaaggccacuccaauccacuagggauuga

SEQ ID NO: 5053 - RNA, 3264 nt, Artificial Sequence
  Cas9 variant
augcgauauaagauaggauuagauauaggcauaacaaguguugggugggcaguaaucaauuuggacauaccgaggauugaagaucuggguguacgcauauucgauagagcagaaaauccacaaacuggcgaaagucuagcauuaccuagacgacuagccagaagcgccaggcgaagauuacgacguagaaaacaccgccuagaaagaauaagaagauugcugauaagagaaggaguccuaacaaaagaagaacuagacaaacuuuucgaagaaaaacacgaaaucgacguauggcaacuaagaguagaagcauuagacagaaagcuaaauaacgaugagcuagucagagucuuacuacaccuggcuaagagacguggauucaaaagcaauaggcaaagugaaagauccaacaaagaaaauagcacaaugcucaaacauauagaagagaacagggccauacugucaggguacagaacugucggagaaaugauaguaaaagaucccaaauucgcauuacacaaaagaaacaaaggagaaaauuacacuaacaccauagcaagagacgauuuagaacgcgaaauucgauuaauauucucuaaacaaagagaguucggaaauaugagcuguacugaagaguucgaaaacgaguauauagcaaucugggccucacagagaccuguagcaagcaaagacgacauagaaaagaaaguaggauucuguacguucgaacccaaagagaaaagggcgccaaaagccacuuauacauuccaaaguuucauagcaugggaacauauaaauaaacuaagauuaauaaguccaucaggaacacgaggguuaacagacgaagaaagaagacuacuguacgaacaagcauuucagaaaaacaaaauaacauaucacgacauaaggacacuucuacaccuaccagacgacacauauuuuaaaggaaucguauaugauuggggagaaucucucaaacaaaaugaaaacauaagauuccuagaauuagaugcauaucaccaaauacgaaaagcaaucgauaaaguauauggcaaaggaaagucgucuuccuucuugcccauagacuucgacaccuucggauaugcuuuaacccuauuuaaagaugacgcugacaucagaucauaucuacgaaaugaauaugagcaaaauggcaaaagaauugcaaaccucgcaaacaagguuuaugacaacgaacugauagaagaacucuuaaaccuaucguuuaccaaauucggucaucucucccuuaaggcuuugaggaauauccuaccuuauauggaacaaggagagguuuacucaagugcaugcgaaaaagcaggauacaccuucacgggaccgaaaaagaaacagaaaacuguacuccucccaaccauuccaccaauaguaaauccagucguaaugcgagcacuaacacaagcucgaaaagucgucaacgcuauaauaaagaaauauggaucaccuguuagcauucauauagaacuagcaagagacuuaagccaaaccuucgaugagagaagaaaaacaaaaagagaacaagacgagaaccguaaaagaaacgaaacagcaauaagacaauuaauggaguauggucuuacuuuaaauccaacuggauuggacauagucaaauuuaaauuauggucagagcaaaacggacgaugcgcauauucgcuccaaccgaucgaaaucgaaagacuacuugaaccagguuauguagaaguggaucacgucauuccauacucuagaucauuagacgacucauauacaaauaaaguucuaguacugacuaaagaaaaccgagaaaaaggcaacaggauuccugcggaauaccuaggaguuggaacugaaagauggcaacaauuugaaacauuuguauuaacaaacaaacaauucuccaaaaagaaaagagaucgacuacucagacuacauuaugacgaaaaugaagaaauggaauuuaaaucacgaaaccucaacgacaccagauauauuucaagauucuuugcuaacuuuauaagagaacaccuaaaauucgcugaaucagacgacaaacaaaaaguauauacaguuaacgguagaguaacaucacacuuaagaagcagaugggauuucaauaaaaauagagaagaaucagaucuccaccaugccgucgaugcugcaauaguggccugcaccaccccaucagauauagcaaagguaacagcauucuaccaacgccgcgaacaaaacaaagaacuugcaaagaaaaccgaaccacaauucccacaaccauggccucauuucgccgacgaauuacgagcaagacuuagcaaacauccaaaagaaucgauaaaagcacuaaauuuaggaaacuaugacgaucaaaaacuugaaagccuacaaccaguguucguaucaagaaugccgaaaagaucuguaacaggagcugcacaccaagaaacacuaagaagauacauagguauagaugaaagaucuggaaaaauccaaacgguugucaaaacaaaauuaagugaaaucaagcuagacgcaucaggucacuucccuauguacggaaaagaaagugacccuagaacauacgaagcuauaagacagagguuauuagaacauaacaaugacccgaagaaagccuuucaagaaccgcuuuauaaaccaaagaaaaacggggagccaggaccaauuauaagaacagucaaaauaauagacaccaaaaaccaaguaauuccacugaaugacggaaaaacaguggcauauaacaguaacauaguaagaauagacguauucgaaaaagacggaaaauacuacugcguaccaguuuacaccauggacauaaugaaaggaguacugccaaacaaagcaauagagccaaacaaacccuacucugaauggaaagaaaugacugaggauuacacauuucgauuuagccuuuacccuaaugaucuuaucagaauagaauugccaagagagaaaacaguuaaaacagccgcaggagaagaaauaaauauuaaagacauguuuguguauuacaaaacaauagacagcgccaauggaggauuagaacucaucucccacgacaauucauuuuccuuaagaggcguaggaucacgaacgcuuaaaagauuugaaaaauaucaaguagacguacuagguaauauauacaaaguaagaggagagaaaagaguaggccuagcuucaucagcucauucaaaaaccggagaaacuauaagaccacuccagucuacaagagauuga

SEQ ID NO: 5054 - RNA, 3267 nt, Artificial Sequence
  Cas9 variant
augccaaaagaauucgacccacuuaagcccgcaaaauacagauuggcauuagacauagggagcaaaaguauaggauucgcuauaauauuucuaaaagaagaugucaacaaacuacuuaaaccuuacgcaauagucagaagcgguguuagaauauucggggacgguaggacuccagcugcaccaggacagcuuggcagcagucuagcagcagaaagacgaguuaaaaggagcauacgacgacaauaugcgagaaaacgaaaaagauuacaaagacugcuucgaaaccuaaaggaacuagguuucuuuccagaugacucuaaacugugcaaaucauuugaagaucuaaauccauaugaacuacgacauaagggccuuacuaaagaguuaaaaccccaugaauuuggaagacuccuaaugcacauggcuaaaaaucguggauuccagucaaacagaaaaguagacuuacuagcagacaauauagacucacaagcaaaagcagaaacuagugcaaugaagagcgcaauagcaacacuacagagucgguuaaacggagaauuugaaacuuuaggcgcauauuuauacgaacgauuuaaaaaaggagaaacuauaaaaucaaguaaaacgcaaaaaggccaaaaagcggaauaugaauucucaauuucaagaagaaugguuaaacaagaauucgaucgacuaugggcugcccaagaacaauucaauccagaacuuuuuaacgagcaggcuaaaaauaccuuaaaagacacuauauuuuuccaaagaaaccucuuaccacaaaaagucggaaaaugcaccuucuugccagagcaugaacgagcaucuaaggcucucccuucaucacaauacuuucgaauaaucucagaacuuaacaagaucaguuuuaccgacgccgaagggcuuauauuaccaauaagccuagaacaaagaaacaaacuacugaaaucacuucgaauaaaacaaaaauuaaguuuugacagaauacgaacggaacuaaauuuagacucaacaguauuaauaaaucuugaacacgcuucaaaggauucuaucgaaggagacaaaacaggauauuuacuaucuaaaaaagaguacuuuggaccggccuggagagacuuaucacuagaaacacaagacgccauuguaacugcacugcucacccacgaaaacgaagcagaacuuguacagaaacucgucgaugauuucaacauagcacaugacguugcaaaagcccuugccaaugcuagauuagaaucacaauauaugagauuaagcaaagaagccauagaaagauuaaucccagaauuagaaaaagguguggacucccaagauggauacaaaguaccggugaaauaucaugaggcaacagaggcagccgguuuuggacaccauagcgcauuacaagaaaauugggcugauuuuccgacccuagaucuaaaacaacuacauucagacgauaacgacaaauacaccguugcagaacuaccguuaccauacuauggaaaaguaauuacacgccaagucgcuuucggaaccggagacguaaaugaucccguugaaaaaagauuuggaaaaauugcuaauccgacaguucauauuuguuuaaaccaaguacguguacuguuagaugagauuauagcuaaauaugguuacccauaugagguaaauauugaacuagcacgagaacuaaaacaaaaccaugaacaacggcagagaaguauaaaacaacaagccgcaaauaaaaaagaaaacgaagaaauccgaagagaaauaaaacaagcguacaaaguugaaaaggcaagaauaauaacagauucagagauuagccgggccgauauagaaaaauggagauuauggagaagaaguaaaaguaagcuauguguauauucagggaaaaaaauaugcgaaacaaugauuuuaaacaaugaaguagaggucgaccauauacuaccuaggaguagaacuggagacaacucauaucaaaacaaaguacucguucuaaauaaagcaaaucgaaucaaaaguaacagaacuccgugggaagcaaaggaacuauuugaagcacagggauggucauacgaagacauauuaaauagaaugcgagcacucgauaaacaccaacuauucagauucgccgaaaauuccauggacauaugggauaaaaacuaucgauccuuugaagcaagagcacuaaaugauaccagauacauaaguagaguaguaaaagauuaucuaaaaguaguaugccauaaagaccgaaucgucguuagcaauggcgcucacacagcccucauaagacgagaauucggacugaacgaucuguugggaaaaaaaggagaaaaaaaucgagacgaccaccgacaucacgcuauagaugcaugcguuauaggugcacuagaccgaucaauguugagaaaauugcaaauagcaauggagguagccgaaaaacaaaauagcgcacgcaauuuugucggcuuacaagaaccaugguuuaauuucagcacacaaguacgcaggucaauaggacaaauauauguaucccauaaaccgaaccauaauuaugaaggagagauuuuugaagcaucaauauacggacuaaggcucauauccgauaagagaacagaaaaguacguaggaauaaaacgaaauccagaaacaggaaaaacugauaaaccuaaaaaauccguaguaguuauaucagaucccaaaacacaaaacagauauggacuacgccauaaauuucacucugaaggacuaccaaaaaaauacuauggacucucaucaaguucaguauucugccucgaaauuuacagagacgaaaaaggaaacuggcaagcuuacacuauaccacgguaugaagcauacagaaucguaaaaagacgaggcguaaacgcauuauaugacaauaaaagaucuaacuuugagggacgaccgcuaguuaugcgucuaaugcgagaugauugcauagcauucgaaaaaaauggagucaaagaaguauauagaauacagaaaauaaauggcuuaaaaaaaaacauaacacuuacuagacacuucgaugcaaauguugacgauagauacagaagaaugcuaaaagcacaaaaggccgaaaaagcaggugaagacuuugauagugaagauuuaugcgaugaccuaguauuuucuucauucggcgcaucaaguuuauauucaaauaaagcacgaaaaguaacgauaucucccaugggcgugcuacgagacccaggguucaaaggcuga

SEQ ID NO: 5055 - RNA, 3267 nt, Artificial Sequence
  Cas9 variant
augaagaaauugguauugggguuagacauaggugucgcaagcgucgguuggggaaucauagacgcagaaaauggagacguacuagacgccggcguaagauuauucagcucaagagacgccagugaaaaugagucacgcagaaccucaagaagacaaucaagaagacucucaagaagaaagaaacauaggagagaacgcauuaaacaacuacuauuagcacacgacauggacguaugugauauaguaaaugaaaauccauaccaacuuagaguaaaaggacuaaacgaaaaacuagaaauaucggaaauuuacgucgcacuaacacaccuugcuaaaaggcggggagugucauaucuagacgacgucgucgaagaagggggagccauaaaaagugaacacuuaaacaaaaauauggaagaaauaaaaucaggaaaaaugcccugcgaaauacaauuagaaagauucgaaaaauacggucaaguaagagguaugauagaaaucaaccaagacacagaagaaucuucauuccuaguaaacauuuucagaacauccgacuauauaaaagaagcgaaaacaaucuuagcaacacaacaaaaauuucacaaacaaauuacaaaugaguucauagacgaauauauaaauauaauggcauccaagagagacuacuuuauaggaccaggaaacgaaaaaucaagaaccgacuacggcguuuacagaacaaacggcgauacaugggacaauuuauucgaaauuuuaauaggaaaauguagcguguuuccagaagaaacaagagcagcaagaagcaguuacguagcacaagaauuuaaccuucugaacgaucuuaacaauuuaaaaauuucaucacuagaaucaggaaaauuaucaacaagucagaaacacgacaucguggaaaaggucaaaaauagcaagaaauuuggcaccaaagauuugcuaaaauacauagcaaguguaugugaauguaaaauagaaaauauagacggaugccgaaaagacaaaaauagaaaacccaucaugcauacauuugaaaacuauaggaaaguacauaaugccuuaaacgaagcggguguagaccuacgacuuucugaagcagauuacgacgaguuaaugaaaaucaugacgcucaauucugaaacacuagagauaaagaaacaauguaaagaaaaacuaccacauuuaacagaagauuaccuaaauguaugucuugucuuaaacaagaaaggagcauucucaggauggcacgcucuaucccuaaaagcuaugaaauuaaugaugccagaauuauacggaacaagcaaaaaucagaugcagauaauccauacuaugcaacucggcaaagcauauaucaaaccuuuaaaccaacaaaaauaucuaaauagugaagcaauuuuggaggagauauauaacccuaucgcagcaagaagcaucagacaaaccauaaaagugacuaacgcgauacuaaagaaauacggaccuuuagacagcguaaucauagaaaugccacgugacuaccaaaccucagaagacgaaagaaaaaugauagagaaaaugcaaaaagaaaacgaaaaggaaaagaaagccgcacuaaaaagagcaagagaagaauacccauucccagacgaggcuuuuagaaaucacaaagaacuagccacgaaacuacgacuaugguaccaacaagaucaauucuguguauacucuggaaggaaaauuucaguaguagaucuaguuagaaauccaaaucaauucgaaauagaccauauaaucccacaaucaguaucccuagacgacagucuaaauaauaaaguucuauguuucagugaagaaaaccaaaagaaaggacaacaaaccccuuucuacuaccacaaaggaaaaucaggaaacuggacuuacgaacaauauaaauuauucgucgaaaaacuauuugacaaaaagaaaauaucgaauaagaaacgagaacuacuauuguuugaagaagauauaaacaaaugggaugucagaagaggcuucauagcacguaaucuaguugauacuagauaugcaagcagaguaauccuaaacagcuaccagcaauauuucggaaaccacgaaaugggcacaaaaguaaaagugguaagaggaaaauucaccucccaauuacgaaagaaauggaaaauauucaaagacagaaacgagagucacucccaccacgcuauagaugcauuaauugucgcagcaacagcaaaucuaagacuuuggaagaaaaauaaacuaggaaucuccgacgaaggaaaaguauacgauaaagaaacuggcgaaauacugccauuugagaaauuaacagccuccgaguacaaugaaaugaugaacaaagaaccauaucucaauuucaaaacaaaacuacaaaauauagagacaaaaguaaaauauagcuauaaaguaucgaagaaaguuaauagaaaaauaagcaacgauacuauauauucaacaagagaacgagacggcauagacuauauuguagguaaaauuaaaaacauauacgacguaaaaaccuacaaagaccaauuccuaaaacgauauaagaaaaacaaagaacaauuccuaauguaccaacacgacccacaaacauuugcaauauuagaaaguauaauggccacuuacccagacgcggagaauccauuuuuagccuacaagaaagaacacggaguaauaagaaaauaugccaaaaacaaagcgggagcaccaguaacauccuuaaaauuuauagacggcgcauuaggacagaaaauagaugucacuuauaaaaacaaagcagcauuacccaaaaacaagaaaguaguacuacaaucaauaaaaccauaucgcgccgacguauacuacgacgaaggaaacaaaagauaucaccuaauaggaguaaaauauucucuauucucauuuucaaaacaaggauaugucauaaaccccauagcuuaucaaaaacuucuagaaaaagaacaaauucauagcgaaaugaaauuuuguuucagucuauauagagaagacauaauagaaucaggagaagacccagacucacugacaagauaucgguuuuggagcaaaaaugaaucagguaaaaauaaaauagaaguaaaaccuauugaaaaaccaaacuuugaagacagaaaaguaaucacaauaacaaagaaaaucaaaauacugaacaaauaucaaacagauguauuaggaaauucuuucaaagcacaagaagaaaaagauccaagaucaaucgaauga

SEQ ID NO: 5056 - RNA, 3267 nt, Artificial Sequence
  Cas9 variant
augaacuauaagaugggauuagauauaggaauugcaagcgucgguugggcaguaauaaaucuagaucuaaaaagaauagaagacuuaggcguacgaauauuugacaaagccgaacacccucaaaauggcgaaagccucgcucuuccaagaagaauagcaagaucagcaagacgcagacuaagaagaagaaaacaucgacuagaacgcauacgaagauuacucguaucugaaaacguucuuacaaaagaggaaaugaacuuauuauuuaaacaaaaaaaacaaauagacguguggcagcugagaguugacgcacuagaacguaaacucaacaacgacgaauuagcaaggguauuacuacauuuagccaagagaagaggcuucaaaaguaauagaaaauccgaaaggaauuccaaagaaagcagcgaauuccuaaaaaauaucgaggaaaaccaauccauuuuagcccaauacagaaguguaggcgaaaugauagugaaagacucaaaauucgccuaccacaaacgaaauaaacuagacucauacagcaauaugauagcaagagaugaucuagaaagggaaauaaaacuaauauucgaaaaacaacgagaauucaauaaucccguaugcaccgaacgauuagaagaaaaauauuuaaauaucuggucuucacaacgaccauuugcgaguaaagaggauaucgaaaaaaaaguaggauucugcacuuucgaaccuaaagaaaaaagggcaccgaaagccacuuauacauuccaguccuucauuguaugggagcauauaaacaaauuacgauugguaucaccagaugaaaccagagcauuaacagaaauagaaagaaaccuccuauacaaacaagcuuuuaguaaaaauaagaugacauauuacgacauuaggaaacuacuaaaccuauccgacgauauacauuuuaaaggucuucuuuaugaccccaaaaguucucucaaacaaauugagaacauaagauuucuagaauuagacagcuaccacaagauccgaaaaugcauagagaacgucuacggaaaagauggaauaagaauguucaacgaaacagauauugauacuuucgguuacgcauuaacaaucuuuaaggaugaugaagauaucgucgcauaccuucaaaaugaauauauaacaaaaaauggaaaaagagugagcaaccucgcaaacaaaguuuaugacaaaagccuaauagaugaauuacucaaccuauccuucagcaaauuugcucauuuaaguaugaaagccauaagaaacauacuaccauacauggagcaaggcgaaauauacuccaaggcgugugaacuagcagguuauaacuucacaggucccaaaaaaaaagagaaagcauuacuccuaccuguuauucccaacauagccaauccuguuguuaugagagcucuaacacaaucaagaaaaguagucaacgcaaucauaaaaaaauacggaaguccggucucaauacacauagagcuggcccgugaucuaucacacagcuucgacgaaagaaaaaaaauucaaaaagaucaaacagaaaaccgaaaaaaaaacgaaacagccauaaaacaacuaauagaauacgaacuaaccaaaaacccuaccggacuagauauaguaaaauuuaaacuauggagugaacaacaaggcagguguauguauuccuuaaaacccaucgaauuagaacgacuauuagaaccaggcuacguagagguagaccacauccuacccuacuccagaagucuagaugacucuuaugcgaacaaaguacuuguacuaacaaaagaaaaccgagaaaaaggaaaccacacaccgguugaauauuuaggacuagguagcgaaagauggaaaaaauucgaaaaauuugugcuagccaacaaacaauuuucaaaaaaaaaaaaacaaaauuuacuaagauuacgauacgaagaaacagaagaaaaagaguuuaaggaacgaaaccuaaacgauaccagauacauaucaaaauucuuugcuaauuuuauaaaagaacauuuaaaguucgcagacggagacggaggacaaaaaguuuacacaauaaacggaaaaauaaccgcccaucuaagaucuagaugggacuucaacaaaaauagagaggaaucagaccuacaucaugccguagaugcagucauagucgcaugcgcaacccaaggaaugauaaaaaaaauaacagaauuuuacaaagcaagagaacaaaauaaagagagcgcaaaaaaaaaagaacccauauucccccaaccauggccgcacuucgccgacgaacuaaaagccagguuauccaaauucccgcaggaaaguauagaagcuuucgcacucggaaacuacgauaggaaaaagcucgaaucgcuaagaccuguauucguaucuagaaugcccaaaagaagugucacaggugccgcucaccaagaaaccuuacgcagauguguaggaauugacgaacaaucgggaaaaauacaaaccgcaguaaaaaccaaacucuccgauauaaaacucgauaaagacggacauuucccuauguaucaaaaagaaucagacccgcgaacauacgaagcuaucagacaacgauuacucgaacauaauaacgaccccaaaaaagcauuucaagagccuuuauauaaaccaaaaaaaaauggagaaccaggcccagucauccgaacagugaaaaucauagacacaaaaaauaaaguaguacacuuagauggcagcaaaacaguagcuuacaacucaaauauugucagaacagaugucuucgaaaaagacgggaaauauuacuguguuccuguuuacaccauggacauaaugaaagguacccuaccaaacaaggcaauagaggccaacaaaccauacucugaauggaaagaaaugacugaagaauauacauuucaauuuucacuauuuccaaacgauuuaguaagaaucguacuaccucgagagaaaacuauaaaaacaucaacaaacgaagaaauaauaauaaaggacauauucgcuuacuauaaaacuauagauucagcaacaggugggcuagaacucauaagccaugauagaaauuuuucacucagaggagucggaucuaaaacauugaaaagauucgaaaaauaccaagucgacguguuaggaaacauccauaaaguuaaaggagaaaagagaguuggauuagcagcuccaacaaaccaaaaaaaaggaaaaacuguugacucauuacaaucaguaucagacuga

SEQ ID NO: 5057 - RNA, 3270 nt, Artificial Sequence
  Cas9 variant
augacugccuuuaaaccaaaccccuuaaauuauauacuaggauuggacaucggaauagcaagcguaggcugggcaaugguagaaaucgaugauaaagaaaauccaguaagauuaauagaccuaggaguccguguguucgaaagagccgaaaugcccaaaacuggagauaguuuagccgcagcgagaagauuagcacgcucagucagacgucuaacacguaggagagcacauagacuacuacgagcaagacgauuacuaaaacacgaaggugucuuaaaaccagaagauuucgaugaaaauggccuagucaaaccauuaccauauaucccaaaacaaccacguaauacacccuggcaauugagggcugccgccuuagacagaaaacucacaccguuagaaugggcugcaguacuacuacaucuaguaaaacauagaggauaccuaucacaaaggaaaaacgaaggggagacugaugauaaagaacugggugcccuacuaaaaggaguagcagacaauacccaugcguuacaagcuggaaacuuuagaacaccagcggaauuagcacucaauaaauucgaaaaagaaaguggucacauaagaaaucaaagaggugauuauucccacacauuuucaaggaaagacuuacaagcagagcuaguacuauuauucgaaaaacagaaagaauuuggaaauccuuacguaucagaugauuugaaaaacggaauagaaaaucuccuaaugacccagaggccagcauuaucaggagaugcuauucagaaaaugcuaggucacugcaccuuugaaccggccgaaccaaaagcugcuaaaaauacuuauaccgcagaaagauucaucugguuaacaaaauugaacaacuuacguauuuuaaaccaaggaaaugaaagacccuuaacagaugccgaaagaacaacacuuauggaugaacccuauaagaaaucaaaauuaacguaugcucaagcaagaaaauuacuagauuuagaugauacagcguuuuucaaaggauuacgauaugguaaagauaacgccgagucugcaacuuuaauggaaaugaaagcauaccaugccauuucuagagcacuagaaaaagaagguuugaaagauaagaaauccccgcuaucguuaaguccagaauuacaagaugaaauuggaacagcuuucucauuauuuaaaaccgacgaagaaauuacaggcagauuaaagggaugucuacagcccgaaauauuagacgcacuucugaagcauauuaguuucgauaaauucgugcaaauaagucucaaagcucuaagaaggauaguuccucuuauggaacagggaaaacgauacgacgaagcaugcgcggaaaucuacggugaccaccauggaagaagaaauagugaagaaacacuuuaucuaccaccgauaccagcagacgaaauccgaaauccaguuguucuuagagcauuaagucaagcaagaaaaguaaucaacggcguaggaagaagauaugguaguccagcaaggauucauauagaaacagcgagagaaguagggaagaguuucaaggacagaaaagaaauagaaaagagacaagaagaaaauagaaaagacagagaaaaagcagcagcagaguuccaagaauacuucccaaacuuuguaggagaaccuaaaaguaaagacauacuaaaacuuagacuuuacagacaacaaaauuguaaaugucucuacucaggcaaagaaauaaacuuaggcagacuaaacgaaaaagguuacguugaaauagaucaugcucuccccuucucacgaacaugggacgacucguucaauaauaaagugcuuguauuagguagcgaaaaucaaaacaaaggaaauagaacaccguaugaauaccuaaauggaaaagacaauucaagagaauggcaagaguucaaggcaagaguugaaacaagucguuucccucauaguaagaaacaaagaauacuauuacaaaaauucgacgaagaagguuuuaaagagagaaacuuaaaugauacuagauauguaaauagauuuuuaugcaaauuuguagcggaccauaugcaauuaacuggcaaagguaaacguagaguauuugcuucaaacggacagaucacuaauuuacuaagaggauuuugggggcuaagaaagguaagagcugaaaaugacaggcaucacgcuuuggacgcugucguaguugcaugcaguacaguagcaaugcagcagagaaucacacguuuuguuagauauaaagaaaugaacgcauuugacgguaaaacaguugauaaagaaacaggagaaguccuacaucagaaaacccauuuuccccaaccuugggaauuuuucgcacaagaagucaugauaagaguauuuggaaaaccagacgggaaacccgagcuagaagaggcugauacgccagaaaagcuaagagcauuauuagcagaaaaguuaucaucacguccugaagcaguacaugaauacgucgcuccacuauucguaagcagggccccaaacagaaaaaugaguggccaaggacauauggaaacaauaaaauccccgaaacgacuugacgaaggaauaagcguagucagaguaccacuuacucaacuaaaacucaaagacuuagagaaaaugguuaacagagaaagggaaccaaaguuguaugaagcauuaaaagcacguuuggaagcacacaaagaugacccagcuaaggcguuugcagaaccauucuacaaacaagacaaagcuggaaacagaacccaacaaguuaaagccguaagaauagaacaagugcaaaagacagggguauggguaagaaaccaaaaugggauagccgauaaugcaacaaugguccgcguagauguauuugaaaagggaggcaaauacuaccugguaccaauauauucauggcaaguagcaaaaggaauuuugccagauaaagcaauuauagcauuuaaagacgaagaagaauggcaauuaauagacgauucauuuaauuuuaaauucccccuucauccuaaugaucuuguagaaguaauaacuaagaaagcgagaauauuuggauauuuugccaguugucauagggguacgggaaauauaaacauaagaauacacgacuuagauaacaaaguaggcaaaaauggaauccuggaaggaauaggaguaaaaacagcguuaucauuccaaaaauaucaaauagaugaacucggaaaagaaauccgaccauguagguuaaagaaaagaccuccuguacgauga

SEQ ID NO: 5058 - RNA, 3270 nt, Artificial Sequence
  Cas9 variant
augaacguaagauauaaaauuggauuagacauagguauaacaucaguaggaugggcaguaguaaaccuagacauaccucgaauagaagaucuaggagucagaauauuugaccgcgcagaaaacccacaaacaggugaaucccuagcuuuaccaaggagacuagcacguagugcacgcagaagauuaagaagaaggaaacacagacuagagcgcauaaggcgccucuuaauaagagaaggcauauugaugaaagaagaguuggacaagcucuuugaagaaaggcaugaaaucgauguuuggcaauuaagagucgaggcuuuagaucgaaaauuaaacucugaugaauuagcacguguuuuacuccaucuagcuaaacgcagaggauuuaaaucuaauagaaaaucagaacauaacagucgagaaaauagcacaaugcuaaaacacauugaagaaaauagagccauccuauccucauauagaacaguugcggaaaugauaguaaaagacccuaaauucgcauuacacaaacguaacaagggagaacacuauacuaauacaaucgccagagacgauuuagaacgagaaauacaauuaauuuuuacaaaacaaagagaguucgguaauaugaacugcacaaaagaauuugaaaaugaauauaucgcuauaugggcaucucaaagacccuucgcuucaaaggacgauauagaaaagaaaguaggauucugcacuuuugaaccaaaagagaaaagagcccccaaagcaaccuauacauuucaguccuucauagcaugggaacacauaaacaaauuacggcuaguaucccccgcagggacaagaggauugacagacgaagaaagaagacuauuauaugaacaagcauuucagaaaaauaaaauaacauaucacgacauuaggacauuauugcgacuaccagaugauacauauuucaaaggggucguguacgacaggaacaugccacugaaacaaaaugaaacaauaagauuucuagaacuagaugccuaccaccaaauaagaaaaguuauagauaaagcauacggaaaagguaaaucgucuuccuuuuuaccuauagauuucgauacauucggcuacgcacucacacucuuuaaagacgacgccgacguccgcaguuaccuacaaaacgaauacgaacaaaauggaaaaccaaugccaaaccucgccaauaaaaccuacgauaacgaacucauugaagaacucuuaaaccuaaguuuuacuaaauucggacaucuaagucugaaagcgcugcauaauauccuaccguacauggagcaaggagaaguauacagcucagcaugcgaaagggcuggauauaaauuuacaggaccaagaaagaaacagaaaacaauguuacuaccaaauaucccuaguauagcgaauccaguggucaugagagcacuaacacaagccaggaaagucgugaaugccauaaucaaaaaguauggaucaccuguaagcauacauauagagcucgcuagagaccuaucacaaacauucgacgaacgaagaaaaacuaaaagggaacaagacgaaaaucggaaaaagaaugaaacugccauaagacaacuaauggaguauggauuaacacuaaauccaaccggacacgauauuguaaaguuuaaauuauggagugaacaaaacggcagaugcgcauacagucuacaaccaauagaaaucgaaagacucuuagaaccaggguauacagaaguugaccacguaauuccauacaguagaucauuggaugacagcuauacaaauaagguccuaguauuaaccaaagaaaaccgugaaaaaggaaauagaacaccagcagaguacuuaggaguaggcacagaaagauggcaccaauucgaaacauuuguauuaaccaacaaacaauucuccaaaaagaaaagagauagauuauuacgacugcauuacgaugaaaacgaagaaacugaguucaaaaacagaaaucuaaacgacaccagauacauuaguagauuuuucgccaauuucauaagagaacauuuaaaauuugcagaaucagaugacaaacaaaaaguuuacaccguaaacggacgaauaacugcacauuuacgaagcagaugggaguucaacaaaaauagagaagaauccgaccuccaucaugcaguagacgccgcaauaguugcgugcacaacaccaagcgauauagcaaaaauuacugccuucuaucaacgaagggaacaaaauaaagaacuagcaaagaaaacagaaccacacuuuccccaaccuuggccacauuuugcagaugaacuacgagcgagacuauccaaacauccaaaagaaaguauuaaagcacuaaacuuaggaaacuaugacaaugaaaaacuagaaucauuacacccugucuuuguuuccagaaugccaaaaagaaguguaacaggagcugcccaccaggaaacacuaaggagauauguaggcauagaugaaagauccggaaaaauucagacaguugucaaaacaaaacuauccgaaauaaaacuagacgccaguggccacuuccccauguacggcaaagaaagugauccgcgaacauacgaagcaauaagacaacgauuacuagaacacaacaacgauccaaagaaagcauuccaggaaccacuuuauaaaccaaagaaaaauggagaaccuggcccuauaauccgaacuguaaaaaucauagacacuaaaaaucaaguaguaccguugaaugacggcaaaacaguagcauauaacagcaacaucguaagagucgauguauucgaaaaagacgguaaauacuauugcguccccguauauacaauggauauaaugaaagguguauugccaaacaaagcaauagaaccaaacaaaccauauucagaauggaaagaaaugaccgaagauuauacuuuccaauuuagcuuauaccccaacgaucuaauacgaauagaauuaccuagggagaaagcuauaagaacaaguacgggagaagaaauaaaaaucaaagacuucuucgcuuauuacaaaaccauccacagcggaacaggaggaauggaacuaauuucacacgaccgaucuuuuucucucagcggaguaggcucaagaacuuuaaaaagguuugaaaaauaccaaguagauguacuuggaaauauauauaaaguccguggugaaaaacguguaggacuugccaguagcgcacauagcaaaacagguaaaacuguaaggccgcuucaaagcaccagagauuga

SEQ ID NO: 5059 - RNA, 3273 nt, Artificial Sequence
  Cas9 variant
augagauggagauuagggcuagacaugggugcagguucccuagguuggugugcaguuggucuagacgaccaagguuacccugacucaauuuuagcagcaggaagccauauuuuuggagacgguagagcacccucaaggggugaucagcaagggacaccacuaggcguagaaagacgagcagcaaaagcgaugagacgacgacgagacagauucuuagggagacaagcaaagcuguuagcuagauuaacacucgcagguuuauuuccagccgaucccguaagggcaaaagcacuagaauuacuugaucccuauguucuaagagccagagcauuagaugaagcauuacccccgcaccagcucgggagagcauucuuccaucuuaaucaaagaagaggauuuaaaucaaauagaaaaacggacagaggaguugacgacgaagcaggaaaaauugccauaggaauagauagacuaagagcagccauagcggcagcagaagcuagaacuaugggggaguucuugcauaaacgacgacaaucagcaccggauguuaaucagauaccuaguguuagaaccaggcuuagaccagaaacaggagaggaggcuaaaggagacggcuacgauuucuauccaggaagagaauuaguagaagaagaguucgacgcaauaugggacgcccaagcgccacaccacccaagucuguugacaccggacaauagggcguuacuucaugaagcaauauucuaucaaagaccacuuaaagcuccaaaaauaggaaaaugcacauuacuaaacaacgaaccaagacuaccaaaggcucacccacucuuucaaagaagaagacuuuuggaagaaguuaacgcacucagaauuguaaggcccggugaaguggcuacaaagcuaaccugcgaacagagagacuuauugauguugaaauuaaaagacaaagcuaaagucagcuucgaaacacuaagaucaaaaguacuaaaauuagaaccagaagcaagauucaauaaagaaggugaaaacagaacagaacuuguaggugaugaaguaugugcacaaauguccgcgaaaacaagauucggaaaagcaugggcucauuuuaccgaugaaaaacgaugggcaauuuuaucaagacuaauugaagaagaagacgaggaaagauuagauacuugguuaagaacagaacauggucuugacgcugaacaagcaagagcaguugcgggugccaggcuuccggcuggguuuggcagguuuggugaaacagcaaccagaagacuaauagcagcucuacaagcagaaguuaucguguauagugaagcaguuguagcagcaggacuaggacaucacagcgacaugcgcacuggugaaguuuuagcagaacuucccuauuaugguaugacacuagaaaggcauuuauuaccgggaacaggagauaaagccgauccagaagaacuccgaauuggacgacucacaaauccaaccguacacauagcauuaaauaggcuuagacguaucguuaacagguuaauaaaaacuuacggacgaccagaacaaaucgcaauagaacugggcagagaacuaaagcuaacagaugaggacaagcagagauuaagucgacaaaacaacagaaacagagcagaugcagaagcaagaaguaaaaaguuggcggaauuaggacaagcagacaauggugcaaauagggcaagacucaaguuaugggaagaguuaaacagagaaaaugcuuuggauagacgauguauuuauaguggucagcaaauaucuaucgcaauguuauucucagaugcaguugaaguugaucacauacugccauuugaugcaacguuagaugauagcaacaauaaucguauucuuuguuuaagagaauggaaucgaagaaaaagaaaacaaaguccuuaugaagcauggggccacaccgauuauuggccagauauagcagcacgagcugccagacuaccaaaagaaaagagauggcgcuuugaaccagacgcuaugcaaagauucagcgcagaagauagauucauagcaagacauuuaguagacacacaauauaugagccguuuagccagagaauaucuugaagcauuauacccugaaaaaggagaaggcuccggucacguauggguuucaccaggaagacugacagaauuaauucguagaaaguuaggacuaaacgaauuauuaccagaucacaauuuugcuggugucaaaaauagauuagaccacaggcaccauacaauagaugcauucguaguagccguaacagauagaucacuucuucagggaauuucucgagcgagugccuuggaaggagaggaaggaagagagagaguaauaguaccugagccaugggacgguuuucgagaagcccucagaacaacucuaaauacaaucacaguauggcacagacaagaccacgggacagcaucuaaagcaggauuagcucaagggagagaccaaacagcaggaaaauuacauaaugauacagcauauggacuuacugggagacaagacaccaaggguaaugauuuaguagugagcagaaagccauuaaugagcuuaaagccagcagauauagaaccagucccugaugucgcaccuauuacuaaaggaguuagagauagagaucuaagaaaagcgcuagcucacuuuacacaggcaacugaaggcaaaggauuccuacaagcgcuagaaagauucacacgacuugguccgcuucauuucagagguauucgacgagugcgauugauccaaccauuagcuguaauaccuauaaaagguccagguggggucccuuauaaaggauaccuaggaggggaaaauuuucgaugugacguaugggaaaugccagacggcgcauggaaaccugaagugacaucgauguuucaagcacaucagccaggcuggacaucagcaauuagagcagcauguccuacagccaggaaagugcuuucacugcacaaaagagauaugauagcaauagaacgagaagaaggugugagaacguugaugguagucgcgcaaauuugguccaauggccaaguaacacucguugaaccccacgaggccggcgacuuaaacaagaggaauaaaucugaagaugauccauuuggauauuuuaugccaacagcuggaggccuaaaaagauuaaaagcaagacaagucagaguagaugaacucggacguguccaagauccagguuuuccagcaaggaaagcccguagaaggaccagaccaaaacagguggauuga

SEQ ID NO: 5060 - RNA, 3273 nt, Artificial Sequence
  Cas9 variant
auggauuggagacuuggccuagauuuaggugcaaauucgcugggaugggcagcauugcgguuagacagggcaggagauccaauuggcauacuagcuauggguucucguaucuucucagauggacgagacccaaaauccggagcuucuuuagcuguagauaggcgagcagccagagcaaugagaagacgaagggacagguucaaacagaggcaggccgcacuacuaaaauacuuaaucagagacggccucuuuccagcagaccaagccgacagacaaagauuagcagaugaagauccauaugcauuaagagccagagcccuagaugaagaacuaucuuuauucgaaauagguagagcucuauuucaccugaaucaaagaagaggauuccagagcaacagaaaggcagacagaggccaagaugaugaagccggaaaaauagccgugggaguagacagacuaaaccaacagauggaagaacagggcgcaagaacauugggggaauuuuuacaucaaagaagaagggcagcaacagaugccaaccauauaccaucuguacguacuagauuaagaccagaaacaggggaaggggcaaagggagacggauaugauuuuuacccaucgagagcacuaauagccgaggaauuugaagaaauaugggcugcacaagcaccacacuauccagauacacuaacgcaacaaguacaugacagauuauaugaaauuauauuccaucagagaccccuaagagcaccacaagucggacaguguacgcuuguugccggagaaacaaggcuaccaaaggcucacccacuauuccagaaaagacgauuauuagaggaaaucaaugcucuaaugauaguaaggcccggugagauagcucaacgauuaacuccugaagaaagggauacguuguaccucaaacuuaaagauaaacgaacaguuaguuuugcgacauugcgaaagaccuugaaacuagacucugcagcuagauuuaauaaagaaagugaaaacagaacugaauuaaaaggagaugaaguagcugcagaacuaggagcaaaaacaaggcuaggaacuagauggcaacaccugagcggggaucaacaaugggaaguuguacacagacuaauggcacuagaaagucaagcggaugaagcagcauuuagagauuggauuucccaaacauacgaccuauuaccagaacaagcagcugcaguauuaggggcaagauuaccacaaggacaugguagauuuggaccaacagcgacaacaacccugauagacucauuauuacacgacagaacugaagaugggcgggugguaguguauagcgaggcuguccaacgaagcggauuaggucaucauagcgaucuacgucacgauagagaugacgaagauguaaccgaauuaccauacuauggaguagcuuuagaaagacauauaaugccgggaacugcagaaccaacagauccugaagaaaugagaauuggucgacuaaccaacccaacuguacauaucggcuugaaucaacugagacaugugguaaauagauuaauuagagccuauggaccaccaaaagaaauagcaauagaauuagcaagagagcuaaaacucagcgaggacgaaaagaagaaaagaaauagcgaaaauagagauaauagacuggcugcggaaggaagaagcaagaaauuagaagaaauaagacaaagagauacgggcgcaaaucgagcauuauuaaaauuaugggaagaguuaaauccugggaauguuuuagaccgaagguguauauauacaggcgaacaaauaagcaucgauaugcuauuuucagauagaguagaaguugaucauauccugccauucgcccagacacucgacgauucaaauggaaauaaacuucuauguuuaagggaagcgaacagagagaaaagaagaaggucaccguaugaggcuuggggacauacagauagauggccagacauugcugaaagagcuucucgauuacccaaaccuaaaagauggagauuugaaccagacgcuaugcaacgauuugcaacugaagacggcuuucuagcacgccaucuaguagacacacaauauuuaggaagauuggcaagagaauaucuaucaugguuguauccaggaagaggagaagguagugggcauguguggguaagcccuggaaggcuuacugaaaugguaagaagaaaacuuggacuuaaugacuuacuaccagaccacaauuuuggaggaggagcugaccagccuaaaaaccgauuagaccauagacaucaugcaaucgaugcgcuaguagucgcaauaguagaucgagggaugcuacaagccauagcaagagcaucaggccaagaugggucagaaggaagagaaaggauucacaucccagccccaugggaugguuuuagggaugaucuuagaguugccgucaauggaauaauaguuagccacagaccagaucacgguacuguagcuaaagcgggucuagcacgagguagggaucaaacagcuggcaggcuacauaaugauacagcguaugguuuaacaggagaaacagaugcaaaaggaaacagcauuguggugcgacggauaccauugagcgcuauaaagaaacccgcagauauagccagaguaagagauccacucuuaagaaaugcuuuagcugaauuuacuaaaggacuagauggaaaagcauuugaagcucgaauuggaagauuccacgaacuaggcccacuacuuuauagaggaaucagaaggguacgagucguagaaacacuaaccguaaucccuauacgggaugcagaagguagggcauauaaagguuauaagggcgacuccaacuauagguacgauguaugggaaaugccagauggaaaauggagaugucaagucguaucaauguuugaugcacaucagagcacugaacaagcucgaccacauccagcagcucgaaaaauacuuaguuuacaaagaaacgacauacuugcaauugaaagaacugaaggcgauagggaauuagugcgcguaguuaaguucucggaaaaacaauuugcugucgcuccuccacaugaagguggauccuuaaaaacacgagacggaaacgcagaugauccuuuuagauauuuauacccgucaccaaauacacucaaaggauggagggcaaggcaaguuagaauagaugaacugggccguguacuagacccagguuucccagcacgcaagucuguaagaagaacuagaccuagggcagcuccuguagauuga

SEQ ID NO: 5061 - RNA, 3276 nt, Artificial Sequence
  Cas9 variant
auguacucuaacuuacuauuuucauucgacauaggaacaaacucaauaggaugguguguuuucgcauuagaugaagcaggagaaccuuauagaauaguggaccucggagcaagaauauacgcagauggaagagacccacaauccaagacaagucuagcaguugcaagaagagaagccagagcaaugagcagaagaagagacagguaucuaagaagacgaaaggcaacauuacgcacaaugauagaauacggccuuaugccaggagacaaagccggccaagaagcaguauuacgcgaaaccggagauagagaaggaggagaugaaaguuuuaauccauaugcucuaagagcaagagcacuuagcgaaaaacuaccaccggcauauauaggaagagugcuauuucaucuaggacaaagacgaggcuuuaaaucaaauagaaaaacugauagaaaagacaaugauaaagguaaaauagcauugggaauagacgaauuaaccgcagcaaugcauagaucaggaaguccaacacuaggagcuuggcuagcaaugagacgugccgaaggacauagcguacgauuaagagcugguuccgaaguauuugaugcagaaggauaugcuuuuuauccagagagaagccuccuagaagaugaauuuagacaaaucugggacgcucaagcaguccaccaucccgacaucuuaaccccagaaagacgagcgcaucuuuucagaguaauguuuuaccaacgaccguuaaagaaaccauuaguaggacgauguaguuuuaacccagcugaguucagauugagucgugcacauccccuauuccaagaauuucggcuauauaaagagauaaaugaucuagaagucguccuaccagaccaaucacacagaaaauuaacauuagaugaaaggaacgcucuuguugcaaaauugaaaacuucaagaaaagcaaguuuuagugcucuaagaaaaacguuaaaacuuaccccagacuuaguauucaacaaagaaucagaagcaagaaaagaauuauugggugaugaaauuuacaguguacuggcagacgcaaaaauguucggugcacguuggggugguuuuaguagagcucgucaaugggaaaucauaacaagauuaaaagaagaagaagacccugcaagucuaaguucaugguuaaaauccgaguucggccuagaugacgaaagaguaacagcaauagcaaacgcgagcuuaccugaugguuauggacgauugggagaaacagcacucgcaaguaugcuggaagaacuaaagacagcaguaauaccggaaucagaagcagcgagacuauguggauacgaucacagcaacuuagcuaaagaacaagaugaaggacucgauacccuucccgaguaccaggagauuuuagaacgacacauaccuccagguacuggagaucccgaugauaucuacgauuuaagaaaaggacggaucaccaaccccacaguacauauaggacugaaccaacuaagaagaguaguaaaugcucuaauucaucgcuuuggacguccgcaaagaauaguaguagaauuggcaagagaccuacaacuauccgaaaaacaaaaagaugacguuaauagaaggauagcgaaaaacacaagagaagcagaaggacgaucucaaaaacuuauagagaugggacaauuagacacaggcuauaacagacuucuucuaaaauuaugggaagaauuaaauuuagacaaaccagaagaccgaguguguaucuacagcggaaaaccaauuggaauagcaaugcuauuuagcggagaaguugaugucgaccauauauuaccguggagcaaaacacuagaugacucacaggcuaauaaacuuuuauguuuaaaaucugcaaauagacaaaagcgaaauagaacaccaucggaugucccagaauggagagauagauaugacgaagugcuugcacgcgcagcuagacuaccaagaaauaagagauggagauucgcggccgaugcaaugcaacaauuugaagcggaaggaggauuuuuggcacgacaacuaacagauacccaauauuuaaguaggauggcauuagaauauuugagcgcauuauaucccagugaagaagcggauaaaaguggagaauuaagacaaagaaaaaggguccauguaguaccaggaaggcuaacugaacuacugagacguaauuggggacuuaacacauuacuacccgaccauaaucuaggugaaauggcacaagagaaaaauagaagggaccacagacaucacgcuaucgaugcagcaguuauaggaacuacgagucggucuuuacugcaaagaaugaguggggcagcagcacgguuggacgauguagcauucgaugacuuaguucggacugugguaaaagauaaucccccguggccgggauuuagggaagaguuacuugcugcuauaggucgcguuacaguaucccauaaacccgaucauggaacuguaaguagagcagcauaugcacaagguaaaggacagacggccgguaaacuacacaacgauacugcauauggacuaacaggauuggucgaugcgaaaggaagcccccugguggucaggagaaaaccauucauggcucuagaaguaaaagacauugcuaguauacgcgauacggaacuccaaagcgcuuuauacggugcaauagguaguuuaacagaaaagaaagcucuacaagaggcacuaauaagauuuagggauacacauccgcaauuuaaaggaauaagaagaguuagaguucucgaaacauuaucuguaauaccaauaguagacagggacggcaaggcauauaaaggauauaaaggagacgcaaacuaccgcuaugagguaugggaaacucuagaugggaaauggcauacugaaguaguuucuauguuugaugcacaucaaccagguuggcaaaguccauuucauaaacagaauccugcagcaagacguguccuaaaauuacaacaaaacgacauggucgcauaugaacauccagcugauggguacacaauagcuagaguuguuaaauucagcaacgauaaaagaauuuacuucgcaucucauagagaaaguggaucauuaaaagcaagagaugcagauaaaggagauccauucucuuauuuugcuaaagcaaacaauggucuaagagauauuaaauguagacaagucagaauagaugcggccggaagaauuuuugauccaggaccucaagaucgggagacgcgacaagcaaauaaagguguuuga

SEQ ID NO: 5062 - RNA, 3279 nt, Artificial Sequence
  Cas9 variant
auggcauacacaaugggcauagaugugggaauagcaucuugugguugggcaauaguugaucuagaaagacagagaauaauagauauagguguaaggacguucgaaaaagcagaaaacccaaaaaacggagaagcucuagcaguaccuagaagagaagccagaucaucaagacggagauuaagacguaaaaaacauagaaucgaaagacuaaaauacauguuuguccggaacgggcuagcuguugauauacaacaccuagaacaaacucuacgcagccagaacgaaauugacguauggcaauugagaguggauggacuugacagaaugcuaacacaaaaggaauggcuccgaguuuugauacauuuagcucaaagaagaggauuucaaucaaacagaaaaacggacggaagcucugaggacggacaaguguugguuaacgucaccgagaacgacagacuaauggaggaaaaagauuauagaacaguagccgaaaugauggucaaagaugaaaaauucagcgaccauaaaagaaacaaaaacggcaacuaccacggugucguuucuagagccucauuauuaguagaaauacauacauuauucgaaucacaaaggcaacaucacaacuuuuuagcaagcaaagauuucgagcuugaauauauuaauauauggagcucacaaaggccaguagcaacaaaagaccaaauagaaaaaaugauaggcacaugcacauuuuuaccaaaagagaaaagagcuccaaaagcaucauggcauuuucaauacuuuaugcuacuacaaacuauuaaccacaucagaauaacuaaugcccagggaaccagaccauuaaauaaagaggaaauagagcaaguuguuaauauggcacucacaaaaaguaaaguaaguuaccaugauauaagaaaagucuuagaucuaucagaagaauaucaauucgugggacuggacuacggaaaagaggacgaaaaaaaaaaaguagaaagcaaagaaacuauaauuaagcuugaugacuaccacaaauuaaacaaaauauuuaacgaaguagagcucgcaaaaggcgaaacaugggaagcaguugauuacgacacuguagcauacgcacuaacauucuucaaagacgaugaagacauuagggauuacuugcaaaauaaauauaaagacucuaaaaauagauuagugaaaaauguagcaaacaaagaauacacaaaugaauuaauagaaaaagucucaacacuuagcuucagaaaaguaggccaccuuucacuaaaagcuuuaagaaaaauaauaccauuccucgaacaagggaugaccuaugauaaagcgugucaagccgcuggauuuaauuuucaaggaauaaguaaaaaaaaaagaucagucguacucccgguaauugaccaaauaaguaacccaguaguaaacagagcacuaacucagacuagaaaaguaauaaaugcauuaauaaaaaaauacggaagcccggagacaauacacauagagaccgcuagagaauuaucaaaacgauucgaugaacgaaaaaauauaacaaaagauuacaaagaaaauagggauaaaaacgaaagagcaaaaaagcacuuaucagaauuagguauaaucaauccgaccggcuuagauauaguaaaauauaaauuauggugugaacaacaagggagauguauguacagcaaccaaccaauaucauucgaaagguugagagaaagcggcuauacagaaguagaucauauaauaccauacucaagaagcaugaacgacuccuacaauaauaggguuuuaguuaugacccgggaaaacagagagaaauccaaucaaaccccuuacgaauacaugggaaaugacacucaaagaugggaugaauucgagcaaagggugacgacaaauccacaaauaaaaaaagaaaaaagacaaaacuugcuacuaaaaggauuuacaaauagaagagaacucgaaauguuggaacgaaacuuaaacgacacaagacauauaacgaaauacuuaagucacuuuauauccacuaacuuagaguucucccccucugauaagaaaaaaaaaguaguaaacacaagcggaagaauaaccagccaucuacgaucgagguggggacuagaaaaaaauagggaacaaaaugacuuacaccacgcuauggaugccguuguuauagcaguaacuucagacucuuuuauacaacaaguaacgaauuacuauaaacgaaaagaaagaagagaacuaaacggcgaugauaaauuccccuuaccuuggaaauuuuuccgcgaagaagucauagcgagguuaucgccaaacccuaaagaacagauagaagcacuucccaaccacuucuacagugaagacgaacuagcagaucuacaacccaucuuuguuagcagaaugccgaaacguaguauuacaggcgaggcacaccaagcacaauuccgaagaguaguaggaaaaacaaaagaaggaaaaaauaucacagcaaaaaaaacugcacugguugacaucagcuacgacaaaaacggagauuuuaauauguauggaagagaaacagauccggcaacauacgaggccauuaaggagagauaccuagaguuuggaggaaaugcuaaaaaagcauucagcacagaucuccacaaaccuaagaaggacggaacaaaggguccguuaauuaaaucagugagaauaauggaaaacaaaacacuaguccacccaguuaacaaaggaaaaggcguaguuuacaacagcaguaucguaagaacugauguauuucaaaggaaagaaaaauacuacuuauuaccugucuauguuacugauguaacaaaaggaaaacuucccaacaaaguuaucgcagcuaaaaaaggauaugaugauuggauugaaguggacgauagcuuuacauucuuguacucguuauauccaaaugaccuaaucuucauaaggcaaaauccaaaaaaaaagauuucguuaaaaaagcgaauagaaagccauucaauuagcgauucaaaggaagugcaagaaauauuaacauauuacaaagguguagacagcucaacggcugccaucgaguuuauaacccaugacggaucauauuacgcaaaggggguagguguacaaaauuuagacugcuuugaaaaauaucaaguugacauauugggaaacuacuccaaaguuaaaggagaaaaaagauuagaauuagaaacaagugacaauaaccauaaaggaaaagacguaaacagcauuaaaucuacaagucgcuga

SEQ ID NO: 5063 - RNA, 3279 nt, Artificial Sequence
  Cas9 variant
augaaauacagcauaggccuggauauuggcauagcaaguguaggcuggaguguaaucaacaaagacaaggagagaauagaagacaugggugucagaauauuucaaaaagcagaaaauccaaaagauggaucaucacuagcuucaucaagaagagaaaaacgaggaucacgccguagaaacagacgcaaaaaacaucgacucgauagaauaaaaaacaucuuaugcgaaagcggacuugucaaaaaaaaugaaauagaaaaaauauacaaaaaugccuaucuuaaaucuccaugggaauuaagagcuaaauccuuagaagccaagauaucaaacaaagaaauugcacagauauuacuacacaucgcaaaaagaaggggauucaaaagcuucagaaaaacagaccgaaaugcggaugauacgggaaaauugcuaucgggaauacaagaaaacaaaaaaauuauggaagaaaaaggauauuuaacgauuggcgacaugguugccaaggaccccaaauuuaauacgcacguaagaaacaaagcaggauccuauuuauuuucauuuuccaggaaauuacuagaagacgaagucagaaaaauacaagcaaaacaaaaagaauuagggaacacacacuucaccgaugacguucuagaaaaauacauagaaguauucaauucacaaaggaauuucgaugaaggaccaagcaaaccuagcccauauuacagcgaaauuggacaaauugcuaaaaugauaggaaauuguacauucgaaucaucagaaaaaaggacagcaaaaaacacauggucgggcgaacgcuucguauucuugcagaaacuaaacaauuuuagaauaguaggcuuaucaggaaaacgaccauuaacugaagaagaaagagauauaguagagaaagaagucuaccucaaaaaagaagucagauaugaaaaacuaagaaagauuuuauaucugaaggaagaagaaagauucggggaccuaaacuacagcaaagaugaaaagcaagacaaaaaaacagaaaaaacuaaauucauaucauuaauagguaacuacacaaucaaaaaacuaaacuuaucagaaaaacucaaaagcgaaauugaagaagauaagagcaaacucgacaaaauaauugaaauauuaacguuuaauaaauccgacaagacuauagaaucaaaucuaaaaaaacuagaacuaaguagagaagauauagaaauccuacuauccgaagaguucagugguacacugaauuuaucuuuaaaagcaauaaaaaaaauccucccuuauuuagaaaaaggacuaucauauaaugaagcaugugaaaaagcugacuaugacuacaagaacaaugguaucaaguucaaaagaggagaauuacuaccaguaguagacaaggaucugauagcaaaccccgugguauuacgagcaauuucacaaacacgaaaaguagucaacgcaaucauaagaaaauacggaacaccacacacaauacauguagaaguagcacgagacuuagcgaaaucguaugacgacagacaaaccauuaucaaagaaaacaaaaaaagagaacuagaaaaugaaaaaacaaaaaaauucauaucagaagaauucggaaucaaaaauguaaaaggaaaauuauuacuaaaauaccgacuuuaccaagaacaggaaggaagaugcgcauacucacgaaaggaacuaucacuauccgaaguaauacuagacgaaaguaugaccgacauagaucauauaaucccguacucaagaagcauggaugacucuuacagcaacaaaguauugguacucaguggagaaaacagaaaaaaaucuaacuuguuaccaaaagaauacuucgauagacaaggaagagauugggauacauuuguauugaauguaaaagcaaugaagauacauccgaggaaaaagagcaaucuacugaaagaaaaauuuacaagagaagacaacaaggauuggaaaaguagggcacuaaaugacacacgauacauaucccgcuuugucgcuaacuaucucgaaaacgcacuagaauauagagacgauaguccgaaaaaacgagucuucaugauuccuggucaacuuacagcacaacugagagcaagauggagauugaauaaagugagagaaaacggcgauuuacaucacgcauuagaugccgcuguaguagcagugacagaucaaaaagcaauaaauaauauaagcaacaucucacgauauaaggaauuaaagaacuguaaagauguaaucccauccauagaauaucacgcagacgaagaaacuggagaaguauauuucgaagaaguuaaagacacaagguucccaaugccauggucaggauucgaucuagaauuacaaaaaaggcucgaaucagaaaauccaagagaagaauuuuacaaucuuuuaagugacaaacgauaccuaggaugguuuaacuacgaagagggcuuuaucgagaaauuacgaccuguauucguaagccggaugcccaauagaggagucaaaggccaagcccaccaagaaacuauaagaaguucaaaaaaaauauccaaucaaauugcuguaagcaagaaaccacucaauaguauaaaacuuaaagaucuggagaaaaugcaaggacgagauacagacagaaaauuguaugaagcauuaaaaaacagacuagaagaguacgacgauaagccagagaaagcauuugcggaaccauucuacaagcccacaaacagcgggaaacgaggaccuuuaguuagggguauaaaagucgaagaaaaacagaacgucggagucuauguaaauggaggacaagcaagcaauggaucaaugguacgaaucgauguauucaggaaaaacggcaaauucuacaccguacccauauacguacaucaaacacuucuaaaggaacuaccaaauagagccauaaacggcaaaccguacaaagauugggacuuaauagacgguucauucgaauuuuuauauagcuuuuauccaaacgaccucauugaaauagaauucggaaagucaaaaucgauaaaaaacgacaacaaacuaacaaaaacagaaauaccagaagucaacuuaucagagguauuaggauauuauagaggcauggacacaagcacaggagcagcuacaauugauacucaagauggcaaaauccaaaugagaaucgguaucaaaacgguaaagaacauaaaaaaauaccagguagacguacucgggaauguauacaaaguuaaaagagaaaagcggcagacuuucuga

SEQ ID NO: 5064 - RNA, 3285 nt, Artificial Sequence
  Cas9 variant
augaaaucaacauuggcuauagcaucuauuucaagucuaggauggguaaucgaauuaggagaaaauagaauaaugagacucggacuagauauugggucaaccaguauagggugguggaucuacgagacaaccgacggacaaauaacaaguguaauagauggaggugugagaauuuucucagauggaagagaucccaaaucaaaagguagcuuagcaguagaccgaagaguugcuagagcacaaagaagaaggagagaccgauauuugcggcgaaaagcagcauuaaugaagaggauggcagaaguaggacugaugccuagcgacccaaaacaagcaaaacaauuagaagcacuugacccuuaugaguuaagagcaagaggacuugacgagacccuugaauugacagaacuuggacgcgcacuauuucauuuaaaucaaagaagaggauuuaaaucaaacagaaaaaccgacgcaggagauaacgaaucgggaaaaauaauugaugcaacagcuagacuagauugggcaaugagagaucaccgggcucggacauauggugaauuuuuacacaugcgacgucaaaaagcagacacaccucguacaacuccagcaguaagaacaagguuaacaauagcagcaagagauggugcagaaaaagaagagucgggguacgauuucuacccugacaggcaacaccugagggaugaguuugaugcauuaugggaagcacaagcugaauaucaugggguuuuaacagaagauuuaagagaugaaauaggaacuauuauauuucaucaaagaccgcuaaaaacuccaaaaguuggcaaaugucuuuuuacuaacgaagaacguguggcgagugcccaccccuugaaucagagacgaauuuuaguugagacuguaaacgcccuaagaguagcccaauuaggagaaguagcacgagcccuuacacuagaggaaagagauacuauauuacaugcauuggauaacaaagcacacacaaaaucacuaagcggaaugagcauaaaauuaaaagcguuagggaaaguaauaaaauuacgaucagggcaauauuucacccuagaaacagcgaacagagaugcaauagcaugugauccuguaagagcuucuuuaagcaaaccggacagaauaggaucauauuggaguacacucgaucauaacgcccagugggaagugguaaaccgaauaagggcagugcaaucugaugcagaucacagagaauugguagcauggcuaguaucccaacauagacucgccgcagagcaugcugaaggagcagcauaugcaccauuacccgaugguuauucaagauuagguauaacagcaacuaaaagaauacuugcugccuuagaggcaaacgucauuccguacaguaaagcaguagagaguugugguuggcaccauucagaugagagaaccggagaaguucuagaccgcuuaccguauuauggagagauacuagacagacacguaauuccaggaacguacgaugacucggacgacgauauuacaagauuuggaagaauaaccaauccuacaguacauauaggacugaaucagcuuaggcgauuagucaauagaauaauagaaguacaugggaaacccgacgaaauaguuguagaacuagcgagagaccuuaaacuaagccaagaccaaaaagcagaugucgaaagaacuauuaaaaagaauacucaagcagcgauaagaagaggagaaaaacuagaagagaugggaguaccaaauacaggaggaaauagaaugguauuaagguuaugggaagacuuaaacgaugacgauguaaugaagagauuuuguccauauacaggacagcgaauaagugcgggaauguuauuugauggaucaugugauguugaucacauucuaccauuuucuagaacuuuggaugacggguucacaaauaaaacccucugucuaaaagaagcaaauagaaagaaaagaaauuacgccccucaugaagcagcagagaaagggcucuuagauagggaugcaauggauucuguagcaaaauaucuacccgacaauaaggcguggagauuugcgccggaugcaauagaacgauuugaaggcgaaagggacuucacagcuagagcacuaaaagacacacaauaucucagccgauuagcaagaaccuauuuagacgccuuauaugauggaggagaugauaaaagucauguuuggguaguaccuggucgauuaaccgaaaugcuuagaagacauuggggacuuaauggacuugaagcauuagcagauagugacgagaaaacaguaaaacggaaaaauagaacugaucauagacaucaugcuauagaugcugcaguuguagcggcuacagauagaucauuaauccagaaaauaucuaagauagcagcaucagaugaacaagcaggagcagaagauacauugaagucaacuccaccaccaugggauagcuuuagggacgauauagcagcccaacuacagaauauaacagugucgcauagggcagaccacggcagaacagauagucuagcaaaagggcguggagaagauacaacaaguggagcacuacacgaagcaacagcauuaggaauaaucgaugaaacccauguaacagucagaauaccaauugaaucguuaaaaagcggacaccucaucgaaggaucuagaaauggauauauaagagacccauaccuaagagaccaauuaacauuagcuacuaaaaacggaagugauaaagauuucacaacaguccuacaaaaauuuuucgaucguaguaaaagauacggagggaccagaagaguacgcauaauuaaaacacugcaagacacugcccgcauaucuguaccacacaaugcaccaauaaaagccuacaaaggaggcaguaaccaugcuuucgaaaucuggaggcugccaaacggaaaaauugaaagccaagucauuacuacuugggaacaucacaaucuaacagaaccgaaacguccgcacccugcugcaaaaagaaucauccgacuacacaaaacagauauggucgcaauagaaagggaugguaaaaccguuauauguuuugugcagaaaacagauccaaguaacggggcguuuuugguaccacauuucgaagcgaacgcagacggaagaaaacggaaaaacgaaccuguagaaugguaccaaaugucagcaaacucccuaauaaaagcagauuugagaagaguagggguagaugaaaugggaagaguacgagauccaggaccaccacccauuagauga

SEQ ID NO: 5065 - RNA, 3285 nt, Artificial Sequence
  Cas9 variant
augaaauacagagugggcuuugaccugggaacuaacagcuuaggaugggccguuguacggcuaaaugccaguggggaaccagauagaauagaaguugcuggcagcagaauauuuucugacggaagggaaccaaaaaguggugcgaguuuagcaggggcaagacgagaugcaagagcaaugaggaggcggagagauagguuuaaacaaagacaagcggcauuaauaaaauaucucacacaagcaggauucuuuccagccgaugaaucagagagaaaagcucuaagcgcacuagauccauaugaacuacgagcaagagcauuagaugaagcauuaccacuagcgcaucuugggagagcauuauuccauuuaaaucaaaggagaggauucaagaguaauagaaagacagaucgaggaaagaaugacgauacugguaaaauaagaauugggguagcgcgacuauacgagcaaaugagagaugcugacgcacgaacacucggagaguucuuacauaaaaggagagcugcugccagugauccaaacgcaauaccacaugugaggacucgaauaguuacacuagcggcagaggaugguaaagcaagcgauguauaugauuuuuauccagauagacaaacucuugaagaagaauuugaagcuauaugggaagcacaaacgagucaccauccggaagcgcugaccgaggagcguagagcacaauucuacgaaaucauauuucaucagagaccuuuaaagcaaccgaagauaggauuuuguacgcuucuaccaccagagaaaagauuaccaaaggcccacccauuauuucaaagaagaagacuacuagaagaaguuaacgcauugagaauagucuugccagggaaagaaacaagagcacuagaaaaagcagaaagagaugcauuauuaagcaaacuuaaucaaagaaagaaagcagcguaugaaagucuaagaaaagcauuaaaauuagacccagaugcuagguucaauaaagaaagcgacaacagagaagacaugauaggggacgaaauagcagcugaaauggcacauaaauccagauucgggaaaguguggcuaggaaugagugcggaagcacaggcccaaguuauagaaagauuaagagguuuagaauccgaugcagaugcagaugacuuugaagcauggcuacgggaugaucaugggcuagcgcaagaacaagcgaaggcaguaacagcggccaauuuaccagaaggcuacggaagauuuggggaaacagcaacgaggaaacuaauugcagcuuuggaacaagaaguaauaguauauucagaagcugugcaaagggcaggucucggucaccacucagacuuacgggauggccaaguguggacagacaagaaaggaaauccagcccuccccuauuauggugcaguauuagaaagacauauaguaccuggaacugcagauccuaacgaaacagacgacgcauuaagaauaggcagacuaacaaaccccacaguacacauaggauuaaaucaacuuagaagaguuguaaaugcauuaaugagaagguacggacaaccgcaggaaaucgcaauugaauuagcaagagaacuaaaacuaucagacgauaggaagaaagaaauaaauacgaggaauagagaaaaucgaaaagcagcagagaaaagaucucagaaauuacgaaauauaggacaagcggauaaaggagguaauagggccuuacuaaaacuaugggaggaacucaauccagaaaauguauuagauagacgauguguauacacagggagaguaauaaguaucgauaugcuauucaguggagcggcggaaguagaccacauacuuccuuuuaguguaucucuagaugauaguaacggcaacagaauauuaugccuaagagaaguaaauagaauaaaacgacaaagaacuccaugggaagcacgagaugaccuacgagcacacuuuggcccagaugcagguugggaagcgauagccgcaagagcagcucggcugccuagggagaaaagauggagauuugaaccagacgcagcaaauagauuugaugcacaagguggguuccuugcacgccaucugaccgauacacaacauuugaguagacuggcaagaagcuacuuaagugcacucuaccccgaaacuggagaaggcucaggacauguuuggguuucuccaggaaggcuuacggaaaugcuuaggagagccuggucauuaaaccaucaucugccagaccacaauauagcaggagcagcaaaucagccuaaaaacagaaaagaucacagacaucaugcaauagaugcgaucguuguggcauuggccgauagagcaauguuaaauagaauagccagagaaucaggcaaagaaggacaugaagcggcgggccgguuaguugcgaguauuccugaaccgugggaaggcuuuagugaugaaguagggagagcaguacgagcuauaacuguuagccauagaccggaucacgggaccgcuaguaaagcaggcagagcuaaagacaaagaugcaacagcaggaagauuacauaacgaaacagcauacggauugacaggagaaaaagaugccagaggacuagauauaguaguuacacgaaaaccauuaagugcuuucaagaaaagugcugacuuagacgcaaucagagaugaugauuuaaaacaaaaacugaaagccugggcagcagguaaagaaggcggagcauucgaacaagcuaugcguaguuucggagauccagagagaggaccuagaagucacccaggacuaagaaggauaaggguuacugaaccauuauccguaaucccaauuagagaucgcgauggaaggccuuauaaagcauauaaaggggacucaaauuauagauuugauauaugggaauugaaaacagguaaauggaaagacgaagugguaaguauguuugaggcacauagaccaaauuggacaaguccaaucagagccgggaacccaacggcuagaaaaguauuaagcguaagacaaaacgauguaauugcaauagagcgagaaaauggcccagaacucaugagggugguuaaauuuagugcaggaucacuagcccuagcacccccacaggaagccggaucauuaaaagcccgagacgcugacaagaaugaucccuuuaaauauguguacggcagcccuagcaguuuacaaagauggaaagcuagacaaguaagaauagaugaacuaggacguguguucgauccuggguuugcaguacgaaguagacgaucaagugaauga

SEQ ID NO: 5066 - RNA, 3291 nt, Artificial Sequence
  Cas9 variant
augaaaaauauauuuucauucgacauaggaacaaauucaauagguugggcuguauuagcacuugauggaaauggagacccaguaagaaucgccgacgcaggaguaagaauauucuccgauggacgagauccaaaaagcaaagcaucuuuggcagaagcacgaagaauggcaagagcaaugagucgaagaagagaucgaacauugagacgcaaacgggccacuuuaagaacuuuagcagagauaggguuaaugccggacacgagcuccgcaaggcaggcacaauuaagagagacaucggauccaaaaagugggaguggacaauugacacgaaacccauaugcauuacgagcauuggcguuagaagagaaacuaccacuauuucauauagguagagcguuguaccauuuaggacaacggagaggauuucaaucuaauaggaaaacagauagaaaagacaacgauaaaggaaaaauugcacucggaauagaagaacuacacgccgcaaugaggcaggauggugcccaaacauacggacaauggcucgcucgaagacacgcacuaggucaagccgucagacucaggagcggagcguuagaccuugaaggagaaggauaugcuuuuuacccugaaaggaaacuacuagaagaugaguuucaucgaauaugggaggcucaagcaagacauuauccagauauauuaacaccagaaagaagagaccaucuauuuacaguuauguucuuucaaaggccucuaaagaaaccuaaaguaggaaaauguaguuuuaauaaccaagaagaaagguuaucaaaggcacacccgcuauuucaggaauuuagauuauauaaagaaguaaacgaacuagaaauagucgaaccagaucuaacucacaaaaagcuaacacuagaccaaagaaaugcauuaguaaagaaauuacaaguaaguagagaggcaucguuugccgcccucaggaaaguguuaaaacuuagaccagaccaacgacuaaauaaagaaucagaaagcagaaccaaauuaaaaggaaaugaaguguaugcaguacuaucggauaagaccagauucggaccgagauggggaacauuuucccaagcagaacaaugggcuauaauagaacgacuaaaagaagaagaagauccuggacgccuauuugcaugguuaagaucugcuuucgguauugaaggagaacaagcugcugauauagccaauguacauuuaccugaaggccauggacgauuaggaaaaacagcccuugaagccaugcuagaagaacucaaggcggagguaauaacagaagcugaagcagcaaaacguuguggauacgaccaugcuagacuagggggagggagugaugaaggagagccagaacuuccacccuaccaagaaauacuucaacaucgaauaccacccgguacgaauaauccugacgauccauaugacauugaaaaaggaagauuuacaaauccaacaguacauauagcacuuaaucaauuacgucauguaaugaauacacucauaagaagauacggaaaaccugcacaaauugcaguugaauuagcgcgagauuuaaaauuaagcgaaagacaaaaggaagaagugaacagaacaauagcaagaaacaccagagaugcagaaagacgcggaaaaacgcuagaagagaauagaauaccaaacacaggauauaaucgcacauuauuaagacuaugggaggaacuaaacccaggaaaaguagaagacagauguuguauuuauacagguaaaccuauaucaauaagcaugcuauucuccggagaaguagacauagaucauauauugccauggucacgcacuuuagaugacagccauggaaacaaacuauugugucuaagagaagcgaacaggguaaagagaaacagagcuccugcagauguaaccgaauggagagacaacuacgacgaaauucucagcagagcagcaagauuaccgcaaaauaagagagacagguuugccccagacgcaauggaaagguuugaaaaggccggagguuuucuagcaagacaauugaccgauacacaauacuuaaguaggauggcuuuagaguaccuagcuuguuuauucccggcugaggaaauggauggauuuggagaacuaagaagacauagauauauuaacgucuguccagggcgauuaacugaaaugcuuagacgaaacuggggauuaaauuccaucuuaucagauagucaauuaggugaaacagcgcaagagaaaaaccgaaaagaucaucgucaucacgcaaucgaugcaauaguuauuggaguaacuggacgaucuuuacuaaauagaauaaguuacgcugcaggacgccuagaagcacaacaauuggaaacacucguaaaagaagcagcggcuacaaauaaacccugggacgguuuuagggaagacguagcaaaaguagugggcgggaucauuguaucacacaaaccagaucaugggacagcaggcagaaaagcaaaagauccugcaagacaacaaacagcaggaagguuacauaaugauacggcauauggauugacaggagaaacagacgcaagaggcaauacaauaguuguacggagaaaaccguuuuuaucccugacgucaaaggacauaccgagcauuagggacgaagcccuuagggcagucuuagaacaacaucuacgaggcauaccagauggaaaagcauuucaagccgcauuagacgccuuuagaaaacaaaaaggauuucaccacuaccauggaauacgacauguucguuugacugaaccccuaagugugauugguauaaaagauagagauggcaaaguuuauaaaggauauaagggagaugcuaaucaacguuacgaugucugggaaacuuuagacgguaaauggcacgccgaaguaguaagcauguucgaugcgcaucaaccuggauggcaaucaagauuccaugcugaaaacccuacugcaagaagaguauuaagauugcaacaagaugauaugguagcacuaaaugcuccugacgguggacgccucuuaguacgaguaguaaaguuccgacaaaacgggcagauuacuuucgcaggucacaacgaaucuggaaacuugaaagcuagagaugcggcaaguaacgaacaagauccuuuuaaauauauuagucgaauggcaucaucuuugaaggauugcggaugucgucaagucagaauugaugcuacaggacaaguauuugauccggguccacaagauagagcaucaagacuacagaaacaaaguaaacgauga

SEQ ID NO: 5067 - RNA, 3294 nt, Artificial Sequence
  Cas9 variant
augaagaaacaaccucaaagguacauauuaggacuugaucuuggaauagcauccguuggaugggcacuaauauuaguugacggagccgaaaauccagucggacuauuagauugcgguguaagaacauuugaacgcgcagaaguacccaaaacuggcgauucauuggcguuagcacgaagacaagcaagaagcguaaggagguuaaucagaagacgagcacaucgacuacuaaggcuaaggcguuuacucaaaagggaaggaauccuuucagcagcagacuucaauucagacgggcuuccaaaucuaccuauagacgcauggcaacuaagaguugcaggacuggaaagaaaauuaacaaaucaagaaugggccgcaguauuacuacauuuaguuaaacauagaggguacuuaucacaaaggaaaagugaaacgcaaacagagaauaaagaauugggacgucuauuagccgguguagcugaaaauucgaaacuauuaagugaaucuagcgaacaauaccgcacgccagcagagcuagccguaaaauuauucgccgaacaaucaggacauuuacgaaauaaaggaggagaauauacucauacauuuaauagauuggaucuacaaaaagaacuacauuuacuauuugaaagacaauacgcauuaggcaauccauucgcuucugcagaguuacaaucaaaagucgaugaauuauuaaugacacaaagaucagcacuacaaggcgaagccguacucaaaauguuaggaaaauguaccuuugagccuucugaauauaaagcggcuaaaaauacauacagugcagaaagauucauauggcuuacaaaauuaaauaaccuuagaauauuauacaacggugaagaaagagccuuggaugaaggagacagaaagaaacuccucgacgagccauauaagaaagcaaaauuaacauacaaacaaguaaggagcauacuaaaucugcccgaauccgcaguauuuaaaggacuucgauacggaaaagauucggacggacuaaaagcugagaauggaacacuaauggagaugaaagccuaucauaaaaucagaaccaucuuggacaaagcaggacuaaaaggagaaugggaaaauagaauuagaaaucccgaaauauuagacaaaaucggcacagcuuucucacuauauaaaacggacgaagauauacaagcagcgcuagccgauuuaagauugccagaaaauguacuagacgcccuuuuagcaggacugaacuuugauaaauuuauacaauuaucuuugaaagcgcuacggaauauacuuccuuuaauggaaagaggaauuagauaugaugaagcauguaaagagguuuacggugaccacagagcucuugcagaaucuaaaaaccagguauuauuaccgccuauucccgcggacgaaaucaggaauccagucguucuuagaacccuaacacaagcuagaaaaguaauaaacgcaauaauacgaagauacggaucaccccagagaguucacauugaaacagcuagagaguuaggaaagaguaaacaagaaagagacaaaauagaccgcaaaaacaaagaaaaucagaaugacagaaauagacuugcaucagauaucagaaaacauuuuaauuuugaacccaccccuaaggacauacuaaaauugagacuauacgaacagcaacauggaaaauguuuauacucggauuuaagagaagaaaaaggagaaugucuauacacaggaaaugucauagaacuucacagacuuuucgaagauggauacguugaaauagaccaugcauuaccauugaguagaacaugggacaauucucuaaauaacaaaguucuaguacuaaaaucauccaaucaaaacaaagguaauaaaacuccauacgaauggcucgauggcgcaaacaauaguagaagauggagagaguuccaagcaagaguacaagguugccauuucccauauguaaagaaacaacgcauucaaacagcuaaacuugacaguaaagcagaacaggguuuccucgaaagaaaccucaacgacaccagauauauaagcaaauuuaugugucaauuuauaacugcaaaccuacgauuagcagaaacaagcaaugcucuaauggaagaaguagcaggagaaaaucccuauuggaaagaacgaaaaagacaacgaguauucgcuccgucagguuccauaauagcacuucuaaggggacucuggggccuaaagaaaguaagagaagacaaugaucgacaucaugccuuagaugcaauuguaguagcgugcaguacuguaagcaugcaacagaaaauaacuaaagcaaugcaacgacgcgaaaccuuagaaacaguagacucagagaccggagaaguaaaaacacgaauaccccaaccaugggauuucuucagacaagaggugaugauacgaguauuuagcgauucuccacgcgaagaacuagcagaaaaacucaauucaagaccugaagcauuacaugauuuugucagcccuuuauuuguaagccgugcucccaauagaaaaaugacaggucaaggccauuuagagaccgugaaaucagcaaaaagauuaagugaaaacauaucugucguacgaaaaccccugacugcauuaaaacuaaaagauaucgaaaauauaguaggguaucccgacagagaaccugcauuauaucaagccuuaagagagcgccuucucgcacauaaagaugaucccguuaaggcuuucgcagauaaaccauucuauaaaccagcgaaagaugguggccaagggagccuuguaaaagcuguaagaauaauugaaaacacaaaacacggacuaaaaauuagaaacggcaucacugacacaaacggagauaugguaagaacagacguguaccagaaaacagauaagaaagguaaaagacaauacuuuauagugcccgucuacgcauggcaaguagagaaaaacgaacuaccaacuguagacugcaaaggguacgaaauagacgacaacuacgaauuuugcuuuucauuauauaaauaugaccugauagaaauacaaaaucccaaugauauaaaccaagaacugagagcuuauuauauaaacugcgauuccucagacgggagauuuuggcuagccuaucacgacaaaagcgcuaaagaacaacaauuucgaauaaguacacaaaaccagccaauaauaaagaaauaucaaguugacacacuagggaaagaaauaagacuauguaaagcagagaaaagaacagcccuaaacgguaaaaagaagaaauga

SEQ ID NO: 5068 - RNA, 3294 nt, Artificial Sequence
  Cas9 variant
augggaaagggugacaucuuauucaguuuugauauagguacaaacucaauaggaugguguguguuugcacucucagauaauggagacccaugcagaauccuagaugcaaacgcuagaauauuugcagauggaagagaaccgaaaaguggaaauucacuagcggaaggucgcagagcagccagagcaauggcaagaagacgagacagguacaaacgaagaagaaaagcaguacuuaggacguuaacugaauacggacuaaugccagcagaucccaaagcuagacaggcuuuaguagcuaaaacuggagauagaggaccgaaaagugaagaagcacuagcagauguauacucccuaagggcaagagcauuaauggaaaaacuacccuuacaccauauaggaagggcauuauuucauuuaaaucaacguagaggcuuuaaaagcaacagaaagacagauaggaaaagcaaugagaaaggggcgauugagacuggaguaaaucgacuuuuagaagaaaugcgagacacaggugcacccacauuaggggcuuauuuagcuaaacgaaggucagauggacgaccgguccgagucagagccggcgcuucagagcaagaggccgaagauggaaaacccgcgaaaaccgcauacgauuuuuauccaguucgcagauuauuagaggaagaauuugacgcuauuugggaaaaacaauacucauaucacccagaaguccuaacagaagaaagaaggggucauuuauuccggguaauguuucaucaacgaccucuaaaaccagcaauaguaggacgcuguucauuuaauagugcagaaacaagauuagcaaaagcucauccguuauuccaagaguucagauuguauaaagaagucaaugaauuggaaguuguaaugcccgaucaaucgcacaggaaacuaacgcuacccgaaagagaucgucucguauuaaaacuccguggacagcgaaaagcgacauacgcggcucuaagaaaagaacuacgacuacgugacuugcgauuuaauaaagaaacagagaauaggacugauaugaugggugaugaaguaacagcugcauuagcagacaaagccguauucggaaaucgauggucaggauuuucaacagacgaaaaauggagaauaguagaaagacuaagggaggaagaagacccuuuugcuuuacacgaauggcucguuagugaacacggcuuaagugacgccgaagcagaacaagcagcaaaagugcaucuaccggacggauauggaagauuagguccuacugcagugucgacuauguuagaggaauuaaaagcugacguuauaacggaagcagacgcagcaagauuagcuggauacgaucacucacuugcuagagcagacgaagauggguuagauagacucccuaaguaccaagagguucuugaaagacgaauaccuccgggaaccaaugacccggaugauccauacgacaucgccaaagguaggauaacaaauccaacagugcauauagcucuaaaccaauucagacauguaguaaaugccuuagcucgacgauucgguaaaccagaucaaaucgccauagaacuagcaagagaauuaaaguuaaaugacaggcaaaaagacgaaguaaaucguguuauaggaagaaacacacgcgcugcugccuuacguucacaaaaacuaagagauauuggucagaaagauaauggauauaauagagcucuacuuaaauuaugggaagaacuuaacccagacaaaccagaagacagagucugcguauacacaggaaggccaauuugcauaagcauguuauuuucaggcgaaguagacguagaucauauuuugccauggagcagaacuauggaugauucacaggcaaacagaaucuuaugcguaguugaagcaaacaggguaaaggcaaauagagcacccgcagaaguagcagaauggggaggaagguaugacgaaauuuuagaaagagcggcaagguuaccgagaaauaaaagauggcgguucgcuagagacgccauggaaaaauauaaggaaaaugaaggauucuuggcgcgacaauuaacagacacacaauaucuuagcagauuagcgagagaauaugcggaggcuuuauacccaacagaagaaccugauagauugggggaauuaagacgucgaaaccacguaagaguaauuccugguagacuaacagagaugcuacggagagguugggguuuaaaugcucuauugcccgaucauaauuucggagcaggacaagccaaaaacagaaaagaccaucgacaucaugcaauagacgcugcaguagucggaguaacaacacgaggucuauuacagaggauaaguacggaagcuggauuaagagaaaaauuagcacuugaagagacaauagcggauaucccaaugccguggccaggauuuagagaggaacugaaagccgccauagaccgggcuguagucagccauaaaccagaccacgggacguugccgaaaccuggugaacaugggagaacagcaggucaauuacacaacgacacggcauacggaauaacaggagaaacagacgcaaggggaaacccaauaguaguaagaagaaaaccauuucuuucauugacggacaaagauauaccuaguauaagggacacagaauuaagaggaagaguauacucagcaacaagcggacuaucuggaagagaacuauccgcagcccuagauuauuuucgaaaaaccgacaaacaauuccgggggauaagacacguacguguaacagaaagucuuuccguaauaccgauaagagauagagauggaaauauauacaaaggguacaagggugacgcaaacuuucgauaugauguuugggaguuaccagauggcaaguggaaagccgauguaguuacuauguuugaugcccaucggccagacagagccgcagaagaacgacguccacacccagcagccagaaaaguauugagucuaaaacaaaaugacaugguagcuugugaacacccaaaagauggauacacaauuggccgaguuguuaaauuuaacacugcaggacaaauauacuuugccgcccacaaugaagguggaagucuaaaagcaagggacgcagaucgagcagacccauuuaaauauuucucaaagagugcuaguggcuuaaaagaaauagcagcaagacaaguaagaaucgaugcaacuggacagguacuagacccuggcccacaagauagagaaucaagauuagcgagaaacaagagacuugaaagagaaagagcauga

SEQ ID NO: 5069 - RNA, 3303 nt, Artificial Sequence
  Cas9 variant
augaaguauacaauaggacuagacaucgggacaagcaguguagguuggggcguaauagauaccgaaaggaaccgaauccaagaucuaggaguaagauuauucgaaagugcagaaaaccaaaaagauggagaaucacuagcaaaaccaagaagggacgcaagaagcaugaggaggagacuagcucgacgagggagucgucucgaaagaguaaagagcauauucgaaaaagccaaauuucuuacuagaggacaaauggggauaacacacgcucgcccaaaugaucccuacagauuacgagcggaaggcuuagaucgucuucuaucaaacgaagaucuauucaucgcaguauaccaucucgcaaaaagaagagguuacaaauccaacagaaagaacguacuagaaggagauggagaagauguacgcgaaggaaaagccguuuuggauggaguagcacaaaauaaaaaacugauggcauuccgaggcuacagaacaguaggagaaauguuuuuuaaggauaguguuuucacagaagcgaaaagaaacaaagcaggaaguuacaaacacugcguacuaagagaaauguuagaagaugaacugggaaaaauacugcaugcucaaaggagucucggaaacaccuuaguuacagauucauucaucucuaagcuucucgaaaaaaaaacaggaguguucguauaccagagaccuuuugcaucagguaaucaaauacucaaacucguuggaccaugcacauucgaaccagaagaaauacgagcagcaaaggcaacauacucuuuucaauacuuuaacguccuacaacguuuaaacaaucuaacaauaaaaaacacagacacaggaacagaaaggaaauugaccagugaagaaagagcaaaaaugauagccuucauuuucucacauaaagaugugcaauacgcacagauaagacucgaacucaaacuaagugauguugauagguucaauaugguuaauuauuucguucaaagaaaagaacuagaaacaaagacagcagaagaacuaagaagggaaaucgaaaaaaaaaccaaauuuccaaguuuaucggacuacuacacaauucgaaagacaguaagcgagauagauucagcguuuuggauccaaauagaaaaacaacacgaugucauagacgcgauaggggaaauauucacauuguacaaaacagaugaagacauaauagcacaacuaaacacaagaaucccuuccauacccagaccaguaguaucagcuuuacuuggacuaagcuuuacaaaauuuggccaccuuaguuuaaaagcucuaagaaaaauuauaccacauuuagaaaacggagacacauaugacguagcuugcgcuaaagcugacccaaaauacacagaucgagcaaaaacaagagcaagaaagcuaagaccccuagauaaagaagaccauucaauaacaaacccaguagccagaagagcuauagcacaaacgaucaaaguaguaaaugccauaauagacaaauacgauucuccgagugaaguacacaucgaauuaggacgggauuuagcaaaaaauuucaaagagagaaugaagauacaaaaagaacaaaaacaaaaucaagaaggcaacgaaagagcuauugcaaaaauacaugaguuguauaaauuagaaaacccacgaggacaagacauaauaaaauuccgauuauggaacgaacaaaacggacaaugcauguauucaggcgaaagaauagaugaaauuagacuauucgacaacgguuacacugaaauagaucauauaauccccuuuucgagaaguuuuaacgauagcuacucaaacaagguacuuguauuaaaaaugagaaaucaagaaaaaaugaacaaaacgccauacgaauauauggggggagacgcagacaccuggcaaagguucgaaaacuuagugaacucaaugcauaauauaggaccaagaaaaaaacaaaaccuccuccuaaaaaaauacgucgcagacgaucucacacuaagaacauuaaaugacacacgauuuauagcuagauauaugaaaaauuauauugaaaacaccuuacuuuuuacggaaggaccacaaaaacagagaguguauacaguaaacggacaagccacagccuaucucagaaaacguuggguacuucacaaagacagaacagaaaacaaccgucaccacgcacaagacgcagucgugguagcaguagcaaccccaagucuaguacagggaauaaugcgacaugcaaaaaugggagaaauaguggauuacuuacauucacaaaaauuugcaccuaacguaacugauauagaaacuggcaaaccauuugaauccgcagacauccaaucagccaaagaaagaauaauagcaaaacaugaacaucgauuaagaauacccgagccuugggagggauucucagacgaacuagacgcaaggaugggagacgaugucguugaaaaacugucauuaagaaaaagcaacauucauggguacaaaacaacaagcgacuucagucagauacacccaauuuuuguaagcagaaugccaaaaagaaagacaacuggaagagcccaucaagaaacauuaagaaguccuaggagguucaaagaguuucaagaaaguguugugcguaccccccuaucaagcauuaaucuuaagaaacuagaagaaaugaguggaaaaaacucggacaaacuacuauacgacauacuaagaaaaagauuacuugcacauggagaugauccuaaaaaggccuuuacagaaccaguucacaaaccaagaaaggacggaacccaaggcccuuugguaagaucaauaaagaugguaagcgaagggcaaagaagugggauucuaguaaauaacgaacaagcauuaguugaccaagacagcaugauaagaauagauauauuuagcaaacccaacaaaaaaggaaaagaugaauauuacauaauucccguuuacgcauaccauuuugcccaaaaagaguuaccaaauaaagucauaacagcgaaagcagaagcagacuggagaaccauagacgacacguucgccuuugaauucucucuauauccaaacgaccugguaaaacuaacuaaaggagacgauaucagauucggcuacuauucaggauguaauagggcacuagcagcuauacauauauugccccaugaccaaaacaugccgcucguuaauaauggcauuaaaaccuuagauaagauagacaaauauguagucgauauacucggggaauaucacaaaguuggcaaagaaacgagacaacagauacaauga

SEQ ID NO: 5070 - RNA, 3303 nt, Artificial Sequence
  Cas9 variant
augggagcgacaaucgugacggauauaaguagaucagcauuugcuuuugauauaggcacaaaaaguauaggaagugcaguauuaagacuugacgauaggggagaaccgauaggaauaauaaacgccgcgguaagaauauaugcagauggaagagaaccaaaaagcggcacaaguuuagcagaaggacgaagauuagcccgaggaaugagucguagaagagaucgguauaaaaggaggaggaggacucuauuaaacacccuaacagaguucggauuaaugccaccaacagacgaagcucgaaaagcacuauuagcagaaaccaacgauagaagauuuggagccguggcaggaaauguauacgcacuacgagcucgagcacuagaugaaaaacucccccuacaucauuuaggaagggcguuauuucaucugaaucaaagaagaggauucaaaagcaauagaaaaacagauaaaagagauaaugaccagggaaaaauagcaagcgguauuucacgcuugggacaaaaacuagaugaagcuggagccagaacuuuaggagaguuccuucauagacaacauagugcuggaaaauggguaagaguuaggccaagccggguuccgaguaaagaugauaaagaggaagacggauauggguuuuauccagaacgaucuuuucuagaacgagaauuugcagcaauauggaaagcacaagccgcauucuacccagagcuccuaacagaagaacguggagaccauuugcaccguguaauguucuuucaaagaccccuaaagagaccgaagguaggaaaaugcucauuuuacccggaugaagacaggcuacccaaagcacauccacuguuucaagaguuucgcuuaguaaaagaguuaaaugaacucgaaguaguacaccgaggugacaggcgagaaaaguuaacacuugaacagcgagacacacuguuuaaucaacuaagaacacaaaggucuuccgcguucacugcacuaagaaaaacauuaaaagcuccaacagggacaagguuuaauaaagaaucggacgcaagagacaaguuaaaaggagaugaaguugcugcagaaaugucucauaaagacagauuuggucaggcuuggauaggaaugccgcuugcagaacgaugggcaguuaucgaaauguuauuagauacagaggauccacuagagguaaaagcauggcuagaagaacauuacggcuuugcagcugauagaauagaugcaauugcagccgcuaaacuuccaccaggauauggaagauuaggugaaacagcucuaagggauauguuagaugaauuaaagaauggaacagucaaagaugacucaggaagggauguaguauuaacagaaagacaagcaauggacaauauauggaaggacaacccugcuuuacaaaggguggucgcagacgcucgugaacugccaccguaccaagaaguuuuaggucgacguauuccgccagggacuggaaaaccagaagacccuuaugacgugcaaaaaggcagauuaaccaacccgaccguucauauaggauuaaaccaauuaaaaagaguaguaaaugcauuaguaagaaggcauggacguccagaccaaauagcacuggaauuagcaagagaguuaaaacuaaacgaagaacaaaaagccgaaaaagauagggaaauagcgaggaauacaaaagcggcacaggcacgaagugaaaaauuaagacaacuagauauagacgauaacgguuacaaucguguucuguuaaaauugugggaggacuuaaauuuaagacagccagaaaacagagaauguauauauugcggaaaggcaauaggaauagguacauuauucucaaaucaagucgacauugaucauaucuuaccauggucaaaaacccuugacgauucacaagccaacagaauaguaugccauguagaaugcaauagacaaaaaggaaaucacgcgccggcugaagugccacaauggcacgaucgauacgaugacauacuagcucgagcugaaagauuaccuagaaauaaagccuggagguuuggccgagaagcgaugaagaaguuuaaagaugaugaaucauuuuuggccaggcaacuaacugacacacaauauuugucccgaauggcucacgaauauguugcugcacuuuacccagacgaggagccugaugaauggggaguauuuacgagacgaaaccacguaagaguaauaccaggaagaaugacagagauguuaagaaggcaauggggauuaaaugccauaaucucagaccaugaccagaaaaauagaaaugaucacagacaucacgcuauagacgcuauagucguuggaguuacaacaaggagacuauuacagagaaucgcuacugcggcgggaggaagagaggcauuagcguuggaggaaacaauagguaagaucgaaccuccauggcccggauucuaugacgaugugaaagaagcuauagacaggauuguugucagccauaaaccagaccaugguucauuaccaaaaccuggagaaccggcacgaacugcuggccaauuacauaacgacacagcauacggauuuacaggagaggaacgaaaagguguaccaaucauggugcauagaguaccauuugccaccuuaacagaaaaagauauaccaucaauaagggacaggcaguuagcggaagcacuguacggggcaauagcugggauaaguggaaaagcugaauuggcagccgcucuagcacgauuuucagcaagcggaccuuauaaaggaauaagacauguuagaguagucgaaccugucuccguaauugcaauaaaagacagggauggaacaccauacaaagguuacaaaggagaugcaaacuacagauacgacguuugggaacuaccgaauggaaaauggacucaugaaguaguauccauguuugaugcccauagacccgacuggcagucugaaauaagaaauaaaaauccagcugcaagaaaaguucuaucauuacaucagaaugauaugguagccuacgaacacccucaagacgguuauaccauaggcagagucguuaaauuuggaucugggggacaaauggcauuagcaggaaauagagaaggaggagcuuugaaaaguagagaugcugauccugaagacagauuuagauacuuuuacaaaucaggaggagccaugagagacgcaagacugagacaagucagaguagaugagacaggacgcguuuuugauccggguccucaagauagagaaaguagaaaugccaggaaacaauccgcagccggguga

SEQ ID NO: 5071 - RNA, 3306 nt, Artificial Sequence
  Cas9 variant
augaaaaccuuaggccuugaucuugguacuaauucguugggaugggcaauuguagaaacaagagacgaacccacaaaauauucagaaggaucaauaguagcuucaggaguaagaauauucucacaaucagaaauggcaggaagagauccccaaucgaaagccucauuagcaguagcaagaagacaggcaaggggaucccgaagacgaagggaccguuaucugaaaagacgacaacggcuggucgauuugcuuguagaccuuggacuaaugccagcagauaaggcagcaagggcagaauuaguuaaaaaucacggagacggaaagacaggagauuugaguucaagcguauaugcauuaagagcucgagcccuugaugaagcauuaaguccguaugaaauagggagagcaauuuuccacuuaaaccagcgaagaggauuuaaaaguaaucgaaaagcagauaguaacgauccagaacaaggagugaucagcgaaggaaugagggcauuggaugagaaaauggcggaagcuggcgcaagaacaaucggagaaugguuacauaugaggagauuacaaggcuuacccguaagggcaagaauagcaccagauggagaagguuacgcuuuuuauccaucacgaggggcguuagaaagagaauuugaccgaauaauggcacgacagacacuauuucauacugaccuguuaacagacacugccauacgagaauuaagagaagucguauuucaucaaagacccuuacgaccaguaaaaccgggaaaauguagcuacaauccauuagaagaaaggcuagcaaaagcacacccauuauuccaaaaauuuaggcuucuaaaagaacugaacgaauuggaaauaguuggugaagaucaaaagcacaucaaauuaacaccggaacaacgaaaugcuuuagcguuacaacuacgaacuucauuaacaaagcaaggaaaaguaccuuuuaguaaacugaggagcacacuaaaauuagggagagaaguaagauuuaauaaggaaacagacaacagaucagauuuagaaggagauguaauauauuucaggaugucuaggccagaauguuucggaaaccguugggcagauuuaccaguugaaaugcaagcggcaauuacagaaagauugcgaacagaaccagauuauaaaacacuaaugaauugguuaaaagccgaaacgggucuagaugaaguacacgcgagagcuguagcugauacaccagugccugacgguuucggaagauuaggacaaucugcauuaacagcauugauagaugcauuggaaaaugaagugggugagggagguuuuguaauuacugaggcagaagcagcaaaaaggguauacggacguacgaacagugaagccgauccagauagaaaaggcguugaugaauuacccaaguaccaagaagucuuggcaagacacauucccccugguaccggugagccagaugauccguacgaugauuuuaugggaagaauaaccaauccaacagugcauauagccuuaaaucaacuaaggagagugguaaaugcacuuauaagaacauauggaaaacccgauagaaucgcaauagagguagggagagaccuuaaaaugaaugauagagaaagagacgaaguuaauagacguauaggacguaauacaaaggcagcuauugaaagagguguaaaauugacagagaccuuuaggcaacuugauacuggauauaauagguuaagauuagaacuuugggaagaucucaaucaaaagccugaaaauaggguaugcauauauugcgggaaagcaauagcaggccacauguuguucaauggagaaacugacauagaucauauauugccguacucaaaaacacuagaugauucgaaagccaacagaauacuauguugcacgaguugcaacagggaaaagaaaaauagaccacccaguaggguaccucaauggagaagcagguauggggagauucuugcacgagcaacuacacuacccaaaaacaaacaguggagauuugcagaagaugcaaugacaagguucggagaagaagagggauuucuagcaagacagcuuacggauaugcaguauauuucuagacuagcacuaacauaucuagcacaucuauacgauuaugaagaaguugauuuggacgguaucuauaaaagacaugcaagggucagagcauuaccaggccgaaugacagagauguuacgcagacaauggggguuaaaugaacuuuuacacgaucauaaucuuauagguggugauguggcuaaacccaaaaauagacuagaucaucgccaccaugcuauagaugccaucguaauugcauguacaucaagggcacuuauccagcgauuagcaacugcaagcgcugcagcagaagaaagaggagcagagagaguaguugaaaggauagauccaccuuggucagguuuuagggaagauguuagggcagcagugggggcaauaguugugagccauaaaccugaccacggaacugugggcagagagggguaugcaaaaggucgcggacaaacagcugguaaauuacauaaugauacggccuacggccacacuggggaaaaagacgcaucaggaaaugauauuguaguacgacguauagccgugacugauauaagauccccggcggacauaagaaaaauaagaacuaaugcacacggacauucagaauuaagagacaggcuauacgaagcaacaagagggcucgaaggcaaagccuuugaacaagccguuuuagauuuuguuaaaggggaugcaaaauuuaggggaauuaggcauguaagaauuacugaaguugccaauccaguuuggauaacccacggagauggaagacauaagaaaggauauuuacccggugguaaugacagauucgauguaugggaacuugcagauggaagaugggaugcagaaguuguaacgacauuugacgcucauagaccgggauuugucccaagaaugaggcuagaaaaucacaaugcuaggaaaaucaugucauuaaagaaaggggauaugauagcauacaacgauccaguaucgggacaacgaauuaucgcuauaguaagaaaauucgaccagcgaaauaaacaguuauauuuagauccacauaacgaagcagguaaccuggacagacgggaaaaagagaaaacguauaaaccacuucgacccaugccuaauccuuuaaagaaauauaggcccagacaagugagaauagacgaaauuggccaaguuuucgauccaggcccauggugggaaagacaagaugguuga

SEQ ID NO: 5072 - RNA, 3306 nt, Artificial Sequence
  Cas9 variant
auggaacaaacaagucucgacuuaagccaagcuaugaagaaagucgcgcaaccucaaaaacccuaccgucucggugucgauguaggagucgcauccauuggcgcagccgcaguaacagauacagaaauacuaggaauacaugucaggacauuugagaaaggugaaauaaauggcaaaaguggacgaaaacccuuaaacgcagauuauagaagacaaaaaggacaaagaaaacgacucaggagaaagaaaaaccgccugcuaaguuuacguaggcuauucaggagaguaggaaugauagaaagcgcagcaauugaagcauuuccaauaagcucgacaucuccuuggcaauuaagaacagaaggauuagacagacgguuaacgaacgaagagugggcacaaguauuguaccacauugcgaaacacagaggauuccagucaaacagaagaguagacauggacgaagcaacaaaauuaagcgaugccgcaggcgauucuccagaaacaaccacaaauacggagagugauucagacacuaagaaaauguuagcaggaguagcagauaacaaaagacuccuugcugagaaaggauaccguacaauaggagaagcugucgcucgugacccaaaauuuagucauagaauacgaaacaaagaagaaucauacucacauacaauaggccgagaugagauuaaugcggaacuaaacugccuuuuucaggcccaaaaucauuacggcaacccacaugcuacagaagaacuuagcgaacaaauuauagauuuaaucaacuggcguagaaaaacaguuaccggugacgauauaaaaaggaugguaggacgaugcacacuagaaccaaaagaauauagagccgcaauacauucuguaagcgcugaagaauuuagaugguuaucaacauuaaguagauuaagaaucguaacucaaggagaaucaagaccauuaacaaaaugugaaugggacaaaguaguagaucucccuuggcggcaagaagcaaucacauauacaucaauaaggaacgcaauagguuuacgacacgauauuagaucaagauucaauauaagauacgaaaccggaggaaagaaaacuaaaaccgauacuaaaaaugaaacaacaaaaggacaauccgcagacgcaguaaccagugaaguuaaaaccgcagaaaaagaaacagcguucaaagcuaaaggauaucacaucuuaagaaaagcauacaaagccuuuggauaugaugagcaaugggaccgagacagauucaauacugaauuguuagacacauuagccacagcagucacauucuauaaagaugauagcgaaauccaagcccaccucgaaacaaacgauaccccagaauacgcaauacagauugcucuacgacucccaacauugacuaaauuuaguaaauuaagcaacaaagcaauccuaaaaauauuaccacacaugagagaacgccaaucauacuccaacgcuugccuacuagcaggcuacaaaaaccaccauaaacaauacgaugauacaccacaaaauggaaaaauaccaagauccgccauagaacauauuaaaaauacaguuguauacaggagcuugaaccaagcccguaggguaauaaaugcaaugguaaaagaauauggagcaccccaagaaguccauauagagcuugccagagauauggagaaaagugcgaaaaagaaagaugaaauagaccuuuggaugaagaaacgcaaaaagaaaaaugacgaauugagggagagauucgguaaaaaccuaucuagagacgaauuauuaaaauacaaacuauacgaagaacaaaauggacaaugugcauauucacuccaaccgauacaauuaggacgauuacuugaaccgaauuacgucgaaguagaccaugcacuaccuagaagcagaucaauggauaauucauauaacaauaaaguccuaguacuaacaaaacaaaacagagauaaaggagaccggacacccuuugaauacuucggagaagaccaagagucaguagacuggaaacguuuuaccaauuggguagaaucaaauccgcaaaugccacaagcaaaaagaagaaaauuacuaacaaaaucacuacaaaaagguauauuagacaauuucucagcgcgaaaucuuuccgauacgcgauauauagcuagagaacuuaaaacuuugaucgaacauuacauucuuaauacuccagaaagagagaaaaccaaauaugaacguuguguaguuauaagcggcaaauuaaccgcacaaaugcgacaacuaugggggauauccaaagcacgagauguaagcgacagacaccacggcagcgaugcagcaguaaucgcauguaucacaccaucaaugguaagacgaaucacaagguacuuacagcuacaggaacgacgugcaaugccaagcgcaccaggaaaaggagaugaacacccagcaguaguugcaagagcaauuccacacgcaccaguaccauggccaacauucgaacacgauuuagaagcugcacucgaaaaaguacucguaucacgaccgcaauccagaaaauggagcggaccaauacacgcagauaccauauauggagaacacaaagaucaagaaacaaauaccgucgcuccaacucaacgaaucaaauuaacacaacuaaccaaaaguaacuauaaaaauaucgucggauacgacgaagaacgaaacaaagacuucauagaccagauagaagaacgccuagaaugccauaauuuuaacggaaaacaagcauucggaacaagccaauccccuauauaucgcauuaagaaaaauggagaacuaggcccagaagugaagaaagucacuauaaaacucccgaucaaaaacucugucuuuaggauaagacguggauaugucaaaaacgcuaaaaauucaacgauauacauaaauaucuaucaaaauacuaaaacaggaaaauucgaaaugcauccaguauacgcaaaagacuuaacaucuagugcaaacgcaagcaaaucauuugaauacucaccagaccuacagcuaguugauacaauaagacgaggagacuacauagaaauaaccagaagaaacggagaaguaauaucaggauacuaugcaacacauaacauaucaacauccguucuagaauuacaaccacaugacacuacagacaguaggaauaaccgcacaccagcaaucaaaacaucacuaaacaucgaacgauuucauauugauauauuagggagaaaacgcagagugguaaggagagcgaaaaauggccuagcugaugacagggacaaauga

SEQ ID NO: 5073 - RNA, 3309 nt, Artificial Sequence
  Cas9 variant
auggguuauaggaucggacuagacauaggcauaaccuccguuggauaugcaauacuaaaaacagacgaaaaaggaucaccguacaaaaucgaacauuuaacuucuguaaucuucccaauagcagaaaauccaaaagacggaaagagccuugcaaugccaagaagagagcaaagaggcgcaagacgcagaaacagaaggacaaaauucagaaaacaccgaacgaaaauguuauucguaaggucggaauuacuaacgauaaaacaaauagaagcaauuuacagcgaaaaacaaaaacuaucauccauauaugaguuacgaacaaaagcacuaaacgaaagacucacuaaugaagaauuauuucgaauacuauauuucuuuucaggucaccggggauuuaaaucuaauaggaaaagugaacucacagaaaaagacauggguccaguauuaacagcaauaaaagauauagaagaaaaguuagcagauggaacauacagaacuuugggagaauacauggaauuagacgaaaaauaccaagaacacaaaagaaacaaagacgguauagaucgguaucuaggaacugccaaaagaagccuaauugaagaugaaauuaaacaaauuauaauagcacaacaacaauucggaaacacgaaacuaacaaguggauuccaaguagcuuuuauaggagacgaagaacaaaccggaauauucaacgaucagcgggaauuugaagaugggccugguaaacaaaguccguaugccggaaaucaaauagagaaaaugauaggagccugcacauuugaagaaaaugagaaaagagcuccgaaagcaucauauaccuuccaauacuuugacuuccucugcaaacuaaauaaccuaaaauacagagaaacaaucggaggggaauaccgauuccuaagucuugaacaaaagaacguauugaaagaaaagguguugaccacacagaaaaucaccuuuucaggugucaagaaauuacucgacuuaccagaacacgcacaauuuaaccuaguaaacuacggaacgaaaagcacagucaaagaaacagaaacuaaaucaguauuuuaugcuaugauaucuuaccacaaauuaaagaaagcaauaccggcaccaaucuuuaguaacuuaagcacagcagaauuggacgaaauaggcagaauacuuacauuauacucaucagacaaaggucggaaaaaugaguucuacagcagauuagcuauaccagaagaaguaguagaagcauuauuaccaauaaauuuuaguaaauucggaaaccuaagccugaaagccaugagaaaaauuauacccuaucuggagaugggucuaguuuacucugaagcugcaacacaagcaggauacgacuucagacauaagaaaauagaccaggcuuauauacacgaaaacguaacaaauccggucguaaaacgggccgccucacaaaccauaaaaauaguaaauaauauaauuaggaaauacggagaaccggacggaaucaacauagaauuagcaagagaacuaagcaaaaauuucagugaacgcaagaaaacgguuaaauaucaagaagaaaaucgugcaagaaacgaaagaauugcagacaaauuaagagaaugcgaauugccugucaacggagccaauaucacacgucuaaaauuauuugaagaacaaggagaauuugauccauacaccggauuaaaaauacccuuugaucgagccuuuucugaagaauacgaaguagaucacauaauaccuuauucuaaaacauuagaugacaguuacggaaauaaaauacuuguuucugcaaaagcgaaucaagaaaaagggaacagaauccccauggaauacuuacaaggaaaaccugaaagaauaaagaaacuagaaaguauuaccgcgacaaucaaaaacccuaagaaacgagaaaaacuacuaaaacaacaauugaccaaggaggauguagacggcuggaaaacuaggaauuuaaaugacacaagguauauaagcagcuuacuacaugacuauuuuaaccaaaauauaucauucgcaaaacuagaaucagaaaagaagaaaagaguaauagccguuaauggagcaauaacaucuaaacucagagcaagaugggguuuuaacaaaauacgagaaaauggagacgaacaucaugcacuugaugcguugauaguagcguguguaacagacaaauacauaaaagagauaacgagcuuuucaaaacgaaaagaaguuagauucaacgaaaacuuguggaaaagggagaaaacaccacaagaaauagaacaagaaguaguacacuuuaagaaagauuacgaucgaauauucaaucaagccuucccauuacccuggacaaacuuccgcgaagaaguaucaugcagaaugucugaaaacccagcagaacuaaugaaaaaucauacaugggaaacauauacagacgaugaaauagcagcucuacgacccauuuucauaguaagaaugccaaauaugaaaacaucaggucccgcucaucaagaaaccauaagaagugguaaacuagaagaaaaaggauuaaacauaucgaggguaagcauagaaaaacuaaaauuagauaaagaaggaacgauuaaaucagguaacgcacaauuuuacaaagauucaggaaaugguuggcaacuguuacacgacaaacucaaaguggccuuggaaaaacaugacggagaugguaguaaagcauucccggacggaguguucaaauaucaauacuuagauaaagaacacacuguaagaaaaguuagauuaguagcaaaaucaacguuacaaacaucacugaaugaaaagaaaucaguagcagacaacggaucaaugauaagaauagaugucuucaggaaugagcaagggaaauaccaauuuguucccauauacgcaaaagaucgaguugcaaagaaacuaccuaaccaagcugucgcuguaggaaaaauagcaaaagaauggccacuaauagaagaaucagauuuuaaauuuucacuuuauagcaaugaucuaaucaggguaaaacacaagaaaggcguaaaacacguaucuaaagacggaaacaaagaagaaaaauccaaaacagacuuuuucggauacuauacgggagccgauaucgcuacagcaaguauaagcggcauaucuccuaacaauuucuucgaauuuagaucaaugggauuagcaacauuaaucagcaucgaaaaauacaaaguagauuacuucgggaauuaccaccaaguaaaugaaaaagugcgccaaaaauucccuaaaaacaggauguga

SEQ ID NO: 5074 - RNA, 3312 nt, Artificial Sequence
  Cas9 variant
augaaauaugacauaggcauagacaucggugucgcaagugugggagaagcaguaauagaucaggagggaaacauccuugaagcuugcaguaauuuauucgaugaggcagaugccgcaucaaauguagacagaaggaacuuuagagagggcagaagaaauaaaagaagagaaagaacaagaguaaaugauuuuaaaaaacuauggacaaaauuuggauuugaaauaccgaaaaacguaaugaacgauacaauauuacuaaggaacaaaggaauaaagugugaauuagaucuaacggaacucuacagcguauuauuauacauguuaaaacaucgaggaaucagcuaccucgaagacgccauagacgaagccaaagggucuaacuacgccaaaggcauagccuuaaaccagaaagaacucaaagaaaaauuaccgugcgaaauucaacuugaaagacuaaaaauauauggaaguuacaggggagauuguauaguaaaaaaagaagaugaagacgaauaucacucaaacguguuuacuauaagugcauacaaaaaagaauuagagauacuauuuagaaaucaaaaacuaccagaagaauuuauacaaggauauaugaaaauuuucgaacgaaagagggaauacuauaucggaccaggaaacgaaaaaagucggacagacuauggaguauacaccaccaauaaagaugaagaaggacacuacauaacugacaaaaacauauucgaaaaauuaauaggaaaauguaguguuuauaaagacgaguuuagagcagcaggcgccuccuacacagcacaagaauuuaacguauugaaugaccucaauaacuuaacaguaaacaacaggaaacugacagaaaacgagaaaaaaaaaauaguggaaaaaaucaaaagcucaaaugcagugaacaugaggucaauaauaaaaaaaguuuuaggagaagauaucgaacaguuugguggugcacgaaaagauaaagcagacaaagaaauauaucacacauuugaaguauauagaaaaaugaaaaaagaguucgaaaaaaacggcaucgauaucgcagacuuuucgcgcgaaaaauuagacgaaauuggaaauauacuaacacuaaauaccgaaacagaaggaauuaaaggcgcacugcacgaagcuaaaaauucauucacuuacucagaaauagagacacuuauagacauacgcaaaaaaaacucaucacuuuuuucuaaguggcaaagccuaucacuaaaaaucaugaacgaacuaauaccucaaauguacgcacagcccaaagaacaaaugcaacuauuaacagaaaugggaguuuucaaauucaaguccguaaaauuuaaaaacaguaaauauauacccguagaagaaauaaucaaggacauuuacaauccuguugucguuagaucaguaagaacaacaaucaaaaugauaaacgaaacaauacgaaaauacggauacccugacaauaucaucauagaaaugccacgcgauaaaaacaguaccgaagaaaaagaacgaauaaaaaaagaacaaucaaaaaaugaaaaagaauaugaaggaauacuaaaaagaauaaaggaugaguaugacauagaaauuaauagagaugacuauagaaaacaagaaaaacuagcuuuaaaacuaaaauuauggaaugaacaagagggaagaugcccauacucugguaaaaugaucagcauauacggauuauuagaagacccacaguuauucgaaauagaucacauaaucccaaaaucgauaaguuuugaugacucaaggaauaauaaaguuuuaguauaucgaagugaaaaucaaaaaaaaggaaauaauacaccuuacauguauuuaagcaaaggcgauaaaaacuggaacuacgaucaauauaaaaguuaugugcugggauuaaagaacaaaggaaacauaucagacaagaaggucaacaacaugcucuuuauggaagacauuaacaaaauugauguguuaaagggguucauaacacguaaucuuaacgacacaagauaugcuucacgaguaguacuaaauaugcuacaaagcuucuucaaugaaaaagaugguugucccaccaaagucaaggugauaagaggaucguuuacacaccaaaugagaguaaauuugaggaucaauaaagacagagacgaaaguuauagucaccaugcaguagacgcaauguuaauaguauacagucaaaggggauacgaagcauauagaaaaauacaagaagccuguguagacuuugaaacgggagaaauaauagaugaagaaagguggcaacaaugcauauggggcaaagauuacgaccaaguaauguacgaagcaaaguggagcaaaauccgagaaaaaauaauagaagcagaaaaaaauguuaaguaucaccaucgagucgacaaaaaagugaacaggggauuaugcaaucaaacaauauaugguaccagaauaaaagacgggaaaauauacaaaauaucauccuacaauauauacgacaauaaagaaugugccagucuacucaaaaugaucaaaggaggaaaagaaagcaaaauccucauguacaacuacgauucaaaaacguacagagacaugaucaaaauaauagacgaauauucagacgagaaaaauccauuuguagcauauaugaaagaaacaggagacuacuuucgaaaauacgccaaaaaacacaacgggccaaagauagaaaaagucaaauacuacaaagaagaggcaggaucauguauagacauaucacacaaauacggauaugaaaaagggucgaaaaaagucauacugggaucauugaaccccuauagaacggaugucuucuuuaaugaaagauuaaagaaauauuaucuaauugggauaaaauauaaccacaucaaaugcgaagggaauaacuacguaauagaugaagacgcauauaacggauuacuuagagacgcaggagucauaagucaugaaaauacaaucaaugauuuggaaaaggucggaguaaaauacuuauucagucucuauaaaaacgauaucauaaaauacgaaaaaaauggcgaaauguuuguugaaagauucuuauccagaacuauggaauaugcaaauaauuacaucgaaacaaaaccaauucacaaaccauuuuuccaaaagaaagacaaaaaaggaaacauaaaaaauagccaaaaccucguaggauugagcaaaacaaaauacauaggaaaacucguaacagacgcauuaggcaauacuuacaugguagaaaaagaaaaguuuucacuaaucgucgauauauga

SEQ ID NO: 5075 - RNA, 3315 nt, Artificial Sequence
  Cas9 variant
augaaacuuauauuagccuuagauaucggcauagcaucuguaggaugggcaguauuagacaagaaaagugaaacaguacucgaagcuggcucaaacaucuuuccagaagcaagugcagccggaaaucaaguaagacgagaaaugagacaagcaaggcggauaaaacgaagacaaaggaccagauuagaugacuucaacaaacuguggcggaaaaauaaccuaaguauaccccaauauaaaagcaccgaaauaguuaaucuaaaaguaaaagccuuaagagaagaaauaucacucgacgaacuuuaccuaauauuauacucuuacuuaaaacacagaggcauuucuuauuuagaagaugcacaagacgacucccuuucaucuucaaacgccuauacaaauggacuacgagaaaacgcaaaagcucuagaaaaacacuacccaugugaaauacaaagagacagacuacaaacgauuggaaaauaucgugggcaaacgcaaauaaccgacgacaauaaugagaaaauagaucuaucuaauguauuuacuauuggagcauacaggaaagaaaucaagaaaguacuggaaacacaaaaacucuaucauaaugaauuaacggacgaacuaugugacgauuacauauuaauauuuaaccgaaaaagaaaauauuaugaaggacccggcaacgaaaaauccaggaccgacuauggacgauuuacaacucgccuugaucaaaaugggaacuauauagacgaagaaaauauuuucgaaaaacuuauaggaaaaugcuccguuuacccugacgaacuucguggagcagcagcaucauacacugcucaagaauuuaaccuccuaaaugacuuaaacaaccucacgauaaacggaaggaaauuggaagaaagcgaaaaacacgccauuguucaaagaauaaaaacaagcaacacgguuaacaugagaaaaauaauagcagauugcaugggcgaaacaauagaaaacuucaguggagcgcgaauagacaaaagcggaaaagaacaauuccacaaauucgaaacauauaacaaaaugagaaaaucacuaucagaaauaggaacggauauugacgaauuuucucgagaugaacuagacaaaauaggauacauuaugacaaucaacacagauaaagaagcucuaauggaagcauucaacgaaagcggguuaaaccuagacgacucagucaaagaaugucugauaucauuccgaaaagccaauucaucgagcuuuagcaaauggcaaucauucagcuuaaaaauaaugaaugaguuaauuccagaaauguacauacaaccaaaagaacaaaugaccuuacuaaccgaaaugggaguagcaaaaggcucaucaggugacuucgccggacucaauuacauaccaguagauguaauaagugacgaaauauauaacccaguugucagaagaucuguccgaauaucauuuaaaauucuaaaugcaguucuaaagaaauauaaaguuuuagacacaauaguaauugaaaugcccagagacagaaacucugaugaagaaagaaaaagaauaacagacagucaaaaacuaaacgaaaaagaaauggaguucauagaaggaaaacuagcccagaucuauaacaucaaacuuucaucaucagauuucaguucacaaaaacaacucagccuaaaacuaaaacuauggaacgaacaagacggaauaugccuauacuccggccgcacuauagaccccgaagacaucaucaaaaacccggaucuuuuugaaauagaccauauaauaccaagaucaaucucauuugaugauucaaggucuaauaaaguccuaguauacaggagugaaaaccaaaagaaaggcaaucaaaccccguacuucuacauaacucacucagauggagcauggaccuaugaacaauuuaaagcaaauguaaugaauuuaagcaaaaagaaagaauaugcaauaagcagaaagaaaguucaaaaccuacucuacucagaagauauaacgaaaagagauguauuaaaagguuucauaaaucggaauauaaacgauacugguuacgcaagccgaguaguacucaauaccguacaaaacuucuucaaagcaaaagaagcagauacaaaaguaaaagucauaaaagggucuuauacacaucaaaugagaucaaacaugaaacuugacaaaaacagagaugaaagcuauucgcaucaugcugucgaugcgauguugaugggauucuccgaaaugggguaugaagcauacagaagauuacaaggagaguucauagacuuugaaaccggugaaauccuuaaaaaugauauguggaaugagaaaaugagugacgacguuuacguagacuaccuauacggaagaaaauggucagccauaagaaacgaaaucgugaaagcugaaaaagauguaaaauuuuggcauuuuauuguuagaaaaucaaaccaaggacuaugcaaucaaacaauaagaggaacgagagaauacgacggaaagaaauacaaaauaaauaaauucgacauaagaaccaaagaaggcgucaaacuauuuaagaaacuagcuuucucggaaaaagaauccgauagagaaaaacuauuaguauaucuaaacgacagacagacauucaacaaucuaguaaaaauauuugaagacuacaaagaugcgccaaacccauucgugcaauaugaaaaagaaacaggcgacguaguaaggaaauacaguaaaagacacaauggacccagaauagacaaacuaaaauacaaagauggcgaaguaggggcguguauugauauaucacacaaauacggacucgaaaaagacucaagaaaagucauuuuggaaaguuuaguccccuauagaauggacgucuacuacaaagaaagugauaaaauguacuaucuugugggaguaaaacaaagugacauaaaaucacaaaauggugccaacguaauagacgaagaucuauacacccgcauauuaauaaaugagaaaaugauagaaccaggucaaucuagagacgaccucgaacaauuaggauaugaauuuagauucaguuuuuacaaaaacgauauaauagaauacgaaaaagaaggaaaaguauucguagaaagauucgugucaagaacaaugccaaaaguacgcaauuacauagaaacaaaaccaaucaacaaagccaauuucgaaaaacaaaauccaguagguuuaggaaaaacuaaaucuaucaagaaauacagaacagacaucuugggcaacagauauuuaugcgaaaaagaaaaauuuacgaaauuuugcuga

SEQ ID NO: 5076 - RNA, 3315 nt, Artificial Sequence
  Cas9 variant
augaaccacuauguacuaggacuagacaucggcaucacaucaguuggcuauggcgucaucgauuuggauaauuaucaauuuguggauuacggaguuagauuauuuaaggaaggaaccgcagaagauaauguaaauaggagaacuaaaagaggcucuaggagacuuaaaagaagacgucaaacuagacuagacgauaugaaagaacuacuacaaaaagaaaaaaucaugucagaaacauaucauagcagcuaugauccauaugacaugagaauaaagggacuaucccaaaaauuaucaaacgacgaacuuaccugugccauacuacacaucaccaaguguaggggaacaacucuagaagcacuagacucagccgaugaagacuccgaaggaacaaaaucaauacugucuaaaaacgaccaagaccucaaaaaauaccacuacguaugucucguccaaaaagaaagauuaaaacaauccggaaaaauuagagguaccgaaaauaacuucaaaaccgacgauuacauaaaagaguuagacgaaauauuaucacaccaagaccuuuccgaagacuuaugugaaaaaauacguaccauaguaagcaggagaagacaauacuacgaaggccccggaucagaaaaaagcccuaccccauauggaagauggauagcccaaggaguagccccaaucgacuugauagaaaaaaugagaggaaaaugcucaguuuuuccugaucaacuacgugcagcuaaaaacucauacacggcagaauuauucaaucuucuaaaugaccuaaauaacuuggaaugcgaaggagaaaaauuaacgacaucacagaaacaagaugucauagacuucguaaacgaaaaagggggcaucacucccaaacaacuugcaaaauugcucaacguugacuuaaaccagauaaaaggauucaggauagacaaaaaugauaaaccauuacuaacagaguuuaaagguuauaaagcuuucaagaaaauauuugauacuaauaacugugaucuauauaaaaaagaucucucaauucuugauggcuuagcagaaauaguaacugguaaaaaagggaucgaagaaagaaaacaagcaauccaacaagcauacccagaaaucgaugaagccauagucgaacaaugcgcuguaaugaaaggaaugacacaauaucauucucuaucccuaaaagccaugcaucuuauuaaccaagaaaugcuacaaucaccaagaaaucaaaugcaaguccuccaugaaucacacguauucgacaaaaacagaguaagucacaaaggacaaaaauacauagaggcagaugaugaagcaauuuuaucaccuguaguaaaacgagcacagagggaaacauuuaaaguaguaaaugcacuaagagaaaaauauggugaguuugaaucaauaguaguagaaacaaccagagauagaaacucacaagaacagaaaaagcgacucaaugacucacaaaaauacuacgaacaagaaaacagaaagguagacgaacuccuaagucaugaaggcuacgacccuagcaagauaaaugggaaaacaaaacuaaaaguaagacuauacuuacaacaagaaggaaaaacagcauauacaaaugcacccauagaucuuaauuuacugauaaaagacgcaacagcauaugaggucgaccacauuauaccucuaucaauaaguuuggaugauaguaucaacaauaaagcauuaauaaauagaacggaaaaccagaauaaaucaaacaugacaccaaucuaugccauccuacgaggaaaacucaauauaucucuagauacauauaagaccguaguuaaaaacaacagaaauuacacaggcaaaaaaaggaguuaucuauuauacgauaaagauauaaccaaguucaguaacaugcaagaauucauagcucggaauuuagucgacacauccuaugccugucgaguaguaauguccacauuaucagacuauuuuaaagacaaugaaauaucaacacauguacauaccguuagaggccgcguuaccaacauguuccgaaacagaauuaauaugcagaaagaaagagaaaaagauuacuuacaccacgcaguagacgcauuaaucguugcuagcauaaaaaaauuaaacuuauuaaacaccuauuuauuaaaguacaauuucaaugacuuauauaacgaagaaaccggcgaagucuucgcaguaggagacgaucaacaaguccuggacccaaaauacauaagauucaucacucaacugaaaacaauauacgacgaaucaaauauguacuacaauggauuaauagaacguaauguuaugcaauucccaccaauaaaaaucucgcacaaaauugauacgaaaccaaacagacaaauaagcgaugaaacuauuuauuccacccgaaccguaggcaacgaagaauacguaguaaaaaaauacucagacauauacgaccccaaauucacccaacuaaccgacgauauaauaaaugaucggccauuagacagauggcuaauguaucgaaacgacaaccaaacauuuaaaauaauacagucgaucauauuagaccauuuccacauauucaaagacgacgaaaaacacuauaguuguacaaaaaaaaaaggccaaauacaguaugcccuaaaagggaagaaucccuuauaccuauacaaacaagaacauggaaaaguacguaaauacgcaaaaaaaggaaauggaccagaaaucacaaugaugaaauauuucgauggcaaacucggaaacaacauagacauaucaaaccauuaucauguccacaacaaaaaagucguacuacuccaaaucagcccauacagaacagauuucuacguaucaccagaaggaaaauacaaaaugcuaacaguaagauaugcuaacgucuuuuauaaagagucaaaaaagaaauacguaauagaugaaaaaugguacgcaagcgagaaaaaacgcaaaaacauaaccgacgacgauaucuucguauguagccuacaccacgaugaguuaauaggcauacaaaaaaaagacggagcaaaauauguuuacgaccuuaguacugaggacggagguaaaccaagauuauaccacggugaaauggaaauacuaaaguuuacagccacaaauaaugauucuaaaaacauuaucgaagucaaaccaauauacacauauugcaagaaacaacuaaugauaagcauagguccaauuacaaaacuugcaaaauacgcaacagauguacuaggaaauguauaugaaguaaaaaaaaacauuauagaccaccuuucacacuuauga

SEQ ID NO: 5077 - RNA, 3318 nt, Artificial Sequence
  Cas9 variant
augggcauacgaauuggacuagauauuggaauagcauccguaggaugggcaguaguagacgacgauuauaacauaauagaaucaggagcaaacauauucaacgaagcaaaagcagcaucgaacguagaccggagaaccuucagacaaacgaaacgauuauuaagaagacagaaaacacgauuaagagauuuugacauauuauggauaaacgcuggauuagacauccccaaagaaaaaguaaacaaacaauuacaauuuagaguucaaggcaugacuauggaacugagcgaaaaugaacuauaugcagcacuuaaaaauaugcuaaaacacagaggcauaaguuacuuggaagacgcucucgaugaagaacaaaguggaaaaagcacauacgaaaaaggcuuacaaguuaaccaaaaagccuuaaaaugugauaaaaugcccugcgaaauacaauacgaacgucuuaugaaauacggaucauauagaggccauaucgaaguaaaagacgaaucaggagaagaaaugauccuaucgaauaucuuuacauuagacgcauacugcaaagaagccaagaaaauauuagaaugucaaaaacaauaucacuccuucauuacagaggcuuuugaagaugauuaucuagcauuguugagaagaaaaagaaaauacuacgaaggccccggaaaugaacaaucaaggacagacuacggcaaauacacgacuaaacucaacccagaaacaggcgaauacgucacugaagaaaacauauuugaaaaacuaauuggaaaaugcucggucuacccaaaagaaaugagagcaagcgcagccucauauacagcucaaauauauaauaugcuuaaugauuuaaauaacuuaaccauaaauggcagaaaacuagaauaugaagagaagaaaaguauaguagaagaaguacaaaaagcaagcagugucaauaugcuaaaaauaaucaagaaaguaauaaaugaagauauaacaacaauagaaggagcacguaaagacaaaaacgauaaagaaauauuccauaaaauggaaaccuacaacaaaaugcgucauuacuuugagaaaaauggacuagaauuuaagaaaauaucaacagacgacuuagaugaaauagguaauauacucacacuuaauacagaaaaagaagcaauauuagaggcuuuuaauaaaucccaacucgaauuaucacaagaagaaaaagaagcguuuauagaaaucaggaagaaaaacgguagccuuuucaacaaauggcacaguuucucucuaaaaauaaugaaagaacuaauaccagaauuauaucuacaaaguaaaaaccaaaugcaacuacuuacagacaugggaguuuucaagaagaaaacagaaauauuccaaaauuacgauaaaauacccacggauguaaucauagaagacauauacaacccaguaguaaaacguagcauaagaauuacagugaaaauagugaacgcacucaucaagaaauacggauauccgagagaagucgucauagaaaugccaagagauagaaacagcgaugaagagaagaaacgcauucaagacgaacaaaagaaaaacgauacagaacuaaagaaaauaauagaaaaagucgaaucagaauacggaauaaaaauaacagacacccacuuuagaaaccauaaaaaccuaagaaugaaacugagauuauggcacgaacaagacggccgcugccuauauaguggcaaagucauagauaucucagaacuacuaaacgauugcaguaaauucgaaauagaucacguaauuccaaaaucuauaucauucgacgauucaagaaguaauaaaguauuagucuacagcacagaaaaccaaaagaaaacaaaccaaacaccauaccaauauuuggagggaaacggaaaagaauggucauucgaugaauacaugaaccaagugauagaguuaaaagacagaaaacuaauauccaaagcgaaaaugaacaaauuauuauucagagaagauauaacaaaaauagaaguucuaaaaggauucauagcucguaacauuaacgauacucguuaugcaaguagaguaguacuaaauucauuccagaaauauuuugagaguaaacaaucagacacaaaagucaaaguaauaagaggauccuucacacaccaaaugaggaagaaauugcaauugagcaaaaauagggaugaauccuacgcacaccacgcaguugacgcaauguugauaugcuacagucaaaugggauacgaggcuuacagacaauuacaagaagauuugauugauccggacucagagaaaauucgcgaccucgggcuauggaaagaaacuauaacugaagcgaaauaugaugaaguacuauacaccgcaaaauggcucgaaaaccgaggaaaaauacaagaagcugagaagaaaguaaaauucuggcauaaaguagacagcaaagcaaacagggcauuaugcaaccagacuauaagaggaacuagaguaauagacggaagcauacaaaagauaaauaaaauuaauauauacucaguggauggauauaaaacguuuaaaaacaugauccaaaaaggaaaagaaaaagauuuccuaauguacagaaaugauaggagauccugggacgacuuaaugaaagucuaccgagaauacucagacgccaaaaacgcguucgcagcauaccaagaagaaacgggagauuauguuagaaaauaugcaaagaaacacaauggaucaaaaauaacuaaccugaaauacugugccaaagaacuagggaguugcauagacaucagccacaaauauggucuggaaaaagacucuagaaaaguaauuuuggaaagucuaagcccuuauaggagcgacguuuacuauaacgcaggcuuaaaacaauacuacauaguugggaucaaaaauagugaucucugcuuuuuaaaaggagaguacuuuauagacucaaaaagauauuuacaaauacucagggaagagggcguccugaccgaacaacacaccuuaaaugauuuagcagcuauaggcacagaguuccaauucagcuuguacgaaaacgacuaccuagaauaugagaaaaauggagaaauaaaaacagaaagguucuuaucgaggacuaaaccuaaacagaaaaacuauauagaaacaaaaucaauagaugcgccuaaaauuaaaaacaagaaacaaaaucuugugggacuugcgaaaagcaaaaguauaaagaaaauaagaguagauauauuagguaaucgauauuaugcaaguaaagaaaaauuuagcuuaaugguagacaaauucuga

SEQ ID NO: 5078 - RNA, 3318 nt, Artificial Sequence
  Cas9 variant
auggauauggcuuggagacuaggacuagaucuaggcacaaauucuuuggguugggcagcauuaagccuagaugcagcaggagcaccagacgcuauauuagcagcuggaucaagaauauuuggggacggucgugauccucagagugggacaucacuugcgguagacaggagagccgcuagagcggcaagaagacgaagagacagauucaaacagcgacaacgcgcacuuuuaaaacaccuggaagcagauggcuuauuucccgcugaucccgagguacaacaagcucuagcagcuuuagauccguaugcuuuaagagccagagcauuagaugaagcacuaucacuucaugaaauaggacgagccuuauuucauuuaaaccagagaagaggguuucaaucgaauagaaaagcagauaggggaaaagaugaagacgcgggaaagauagcgauaggaguagauagauuaaaagacgcuauugcggcugcuggagcacgaaccuuuggugaauuuuugcgucaaagaagggcuggagcaaccggagagaaccaaauuccuaguguaagaacaagacugagggcggagacgggagaaggagcgaaagggaguggauaugacuucuacccaucaagagcguuacuaaaagacgaauuugacgcgaucuggcaugcccaagcagaacaccaucccaaaguauuaacugaugaagccuaucacagacuacacgaaauaguauuucgccaaagaccacucagagcaccuaaagugggggcaugcacauuaguuccuggggaggcuagauugccaaaagcacauccuuuauuucaaaggagaagacucuuagaggaauuaaaugcacuaaugauaguaagggcuggagcgguggcggaaagguuaacuccagaacaaagagaccuacuauuacugaaacuuaaggauaaaggcaagguuacauuuaagucauuacgugaaaaaguuuuaaaacuugacggugaugcuagauucaacaaagaaagugaacauaggacagaacuuaaaggagacgaaguagcagcagaaauggguggaaaaacgagguuugguucacucuggccccaucugucaacagagcaacaguggacaguaauagaaagacaacaagcgcuagaaucggacgcagacgaagcggcguuuagaacauggcuaguggagacacauaaacucacagcagaacaagcaagagcuguagccggagcacgcuuacccgccggacacggaagguucggacucacggcuaccgcugcacuuuuagcagcauuacgggauggccgcacaccugagggaagagggcccaaugcgccagcuacugaagcaggaagaguaguuguguacucggaagccgcagcaauagcaggauaucaccauagcgaucauaggaguggugagguauucacagaugcaaaggguaggccugcauuaccuuacuauggagugccacucgaucgacauauaguaccuggaacagcagauccagaugagcccgacgaagccgcacguauagggagauugacaaacccgacuguacauauagcacuaaaccaauuacgucgaguugucaauaggcuuauaagaguauauggaccaccagcagagguagcauuagaauuagcgagagaacucaaguuaagugaagacgaaaagaaagagagaaaucgagaaaauucuaggaacagacuugaugccgaaaagcgaaguucuaaauuagccgaauuagggcagcgagacaaugguggaaauagagcauuauuaaaacuuugggaagaauuaaacccagaaaauauauuagaccgucgauguauauacucaggucgacaaaucaguauuggaaugauuuucucaggagcugcugaagucgaucauauacuuccuuuugaugcaacauuagacgacucaaacgcuaauaaaauuuuauguuuacgagaagccaauagagauaaaagaaaacguaguccuuuugaagccuggggugggacaccucaaugggaagagauagcugagagggcaagucguuuaccaagaaauaaaagauggagguuugaaccagacgcaauggaaagauuugcagaagaaggugguuuucuagcuagacauuugguagacacacaguauuuaggacgaauugcucaugacuauuuaagauguuuauauccagacaaaggcgauggcagcucacacgucuggguaucaccgggaagacuaacagaaaugguacgaagaaaacuuggauuaaauggauuguuaggugaucauaaucuaggagcagaacaaccuaagaacagaaaagaucacagacaucacgccauagaugcaguuguaacagcuauauuagauagaucaauguuacaacguauucaacgagcuucuggugagggggcgucugacgcagaauugcugaggauaaucgucccugagccuuggacgggauuucgagaugacuuacaaagagccguggacaggauaguagucgcacauagggcagaucaugggacuguugcgaaagcagcaacacgagguagagaucaaacagcugcacgauugcacaacgauacagcauauggauuuacaggagaagcagaugcuaaaggaacaccuauuguaguacacagagcaccacuaggagcauuaaagaagcccgaacacauugaucaaguaagagauccauuauuaagagcagcacuucacgauuuuaccgcuggccuaucaggaaaaccauucgaggacagaauagcagcauuuccaagauuaggaccacuagacuaucgagguauaagacgcguuagaguaguugaaccucuacaaguuauaccaauaagagaugcagcuggcagagcuuauaaagguuauaaaggugauuccaauuaucgauaugacguaugggaauuaccugacggaaagugggaacaaaggguuuugcaaauguauuacgcucaucaaucaggagaaccaccuaggccccacccugcugcuagaaagguccuuucacuucauagagaugauguacuagccauugaaagaggugaaggagguagagaauuaguacguguuguaaaauuuucaacaaaugaauuuacucuggcaccguuaaaugaagguggggcucucaaaagcaggcacgccgacaagggcgauccguucagauauuuauauccaucuccaucaacuuuaaaagcguggagagcaagagaaguaagggucgaugagcuuggacgaguauuagacccaggguuuccggcaaggaaaagaagaagaguuacaagaccggggagagcagaugcugauuga

SEQ ID NO: 5079 - RNA, 3321 nt, Artificial Sequence
  Cas9 variant
augcaauacauuguggcuauagauauagguguggcaucaguaggguaugcaguaauagacaaaacaagugaaacggugauagaagcaggcucaaacauauuuccagaagcaagugcaacagacaaucaagaaagaagggguaugcgacaagccagaagauugaaacgccgagaaagaacaagauuagacgauuucaccaaauuaugggaauaccacgggcuugcaauaccacaagucaagaaaaaugacauuguaggacuaaaaguaaaagcacucuacgaauccaucaguuuagaugaaguauaccuaauacucuauaguuacuuaaaacaccggggaaucucauauuuagaagacguagaagauucaucgguaucaggaaguacagcuuaugcaaauggucuaaaacuaaaugcaaaagaacuagagaaaaacuucccaugcgaaauccaaaaauacagacuagaaaacauaggaaaauauagaggacaaauacaaauagaagaugaccaaggagaaaaauuagauuuaaguaauguauuuacaauuggagcuuacacaaaagaaauacaacaaauauuagacacacaaaagaaauaccaugcagaaaucgaagacgaguucugugaaaaauaccuaaaaauauucacacgaaaaagaaaauauuaugaagguccugguaaugaaaaaucaagaaccgauuacgggaaauacacgaccagacucaaagaaaauggagaauauauaacugagaaaaauauuuucgaaaaacuaaucggaaaaugcucaguauacaaagaugaacugcgagccgcuucagcaucauacacggcacaagaguucaaccugcucaaugaucucaacaaucuaaccguaaauggaagaaaacuagaagaaaaugaaaaacaccucauagucgacaaagugaaaacgaguaauacaaucaacaugagaaaaauaauagcagacgcaaugggugaaaagauugaagaguucuacggagcaagaauugacaaaagugaaaaagaaauauuccauaaauuugaaguauauaacaaaaugagaaaagcacuagcagcuauccauguaaauauagaagaguucagcagagacgacuuagacgaaauaggauacauacuuaccauaaacaccgauaaagaagcuaugauggaagcauuugacaauucccgauuagaauuaccaggcgaaaucaaaaacugccuaauuagccuacgaaaaacuaauggcacucuauacucaaaauggcacucguuuagcuuaaaaauaaugaaugaauuaauaccagaaauguacaggcaaccaaaagaacaaaugacauuacuaacagaaaugggaguaaugaaagggcaaacugaugaguucgagaaaaauaaauacauccccguugacguagcgucagaagacaucuucaauccaguaguaaggaggucaguacgcauuagcuuuaaaauacuaaacgcauuaaugaagaaauauggaacuuuagacgaagucgugauagaaaugcccagagacaggaauagugaugaacagaagaaaugggaaaaagaaacacagaagaaaaacgaaaaagaacaagaauauauagaaaacaaacuagcuacaguguacgacauaaggcuuucguccgcggacuucagcucccaaaaacaacugaauuuaaaacugaaauuauggaacgagcaagacggaaaauguuuguacuccggaaaaaucauagaaccagaagauuuaauuaaacauagugaacuauucgaaauagaucauauuaucccuagaucgauuucauucgacgauaguagaucaaauaaaguuuuaguauauagaacagagaaccaaaacaaaggcaaucaaacacccuacuacuacuuaacacacacuaacaguaaauggucauucgagcaauauaaagcauuaguaauggaccugucuaaaaagaaagaauauggacuuagcaaaaagaaaguaagaaacuuauuauacagcgaggacaucaccaaagccgauguacuaagaggauucauaaaccguaacauaaacgauacauccuaugcagcaagaguaguucuuaauacaguacaaggauauuuucgagcaaaagaaaugggaaccaaaguaaaaguuaucagaggaaguuacacacaccaaaugagagugaacaugaaauuagauaaagaccgagaaaaaucauacgcucaucaugcgguagacgcaaugcuaauagcauuuagucaauuaggauacgaagccuacagaaaauuacaaggagaauuuauagauuuugagaccggugaaauauuaaacagcgaaaaauggaaagaccaaaugucagaugagguauauaaacaauaccuauauagaaagaaauggucuaauauucgaaacgaaauaacaagagcugagaaaaacguaaaauacugguauuauguagaucauaaaagcaaucgcggacucugcaaucagaaaauuaggggaaccagaguguacgauggaaaaaucuacaaaauaaauaaacuggacauacgcaagaaagaaggagcagcacuauuuaagaaacuagcauuuucagaaaaagaaagugaucgagaaaaacuauuaguauacaaaaacgauaagaaaaccuacgaagaucuaguuagaauaaugcaagacuacucugacagcaaaaauccguuuguacaauacgaaaaagaaacuggcgauuauguaaggaaauaugccaagaaacauaacgggccacgcauugauaaacuaaaauacauagacggggaaguaggaucaugcauagauauaucacacaaauacggcuacgaaaaaggcagcagaaaaguagugcuagaaagccuaguaccuuauaggauggauguguacuacaagaaagaagaacaaacauauuacuuagugggaauaaaacaaucggaugugaaaugucaaaaaggagaauacguuauagaugaagacgcuuacgccauaaaccuaguuaaggagaaaaugauacaacaagggcaaaagagaagugauuuagagucacuugguuuugaguuccaacuaucauucuacaaaaacgacauaauagaauaugaaaaagaugggaaaauaguaagagaaagauuuuuaagcagaacaaugccgaaagucaaaaauuacauugaaacaaaaccaauugacagagcaaaauacgaauggcaugauagaaagcuaguaggauuagggaaaaccaaaagaauuagaaaauaucgaauggacaucuuagggaacuacuacuugugcaacaaagaagaauuuagcaaauacuguuga

SEQ ID NO: 5080 - RNA, 3324 nt, Artificial Sequence
  Cas9 variant
augggcuacaccguaggauuagacauaggagucgcgucgguaggaguagcaguacuagaugagaaugauaacauaguagaagccguaagcaacauauuugaugaagccgacaccucgaauaacaaaguacguaggacacuaagagaaggaagacgcacaaaaagacgucaaaaaacaagaauagaagacuuuaaacaauugugggaaacaaguggcuacauaauaccucacaaacuucauuuaaacaucauagaauuaagaaacaaaggacuaacagaacucuuaucuuuagacgaacuauauuguguacuauuaagcauguuaaaacacagaggaauauccuaucuagaagacgccgacgacggagaaaaaggcaacgcauacaaaaaagggcuugcguuuaaugaaaagcaacugaaagaaaaaaugccaugcgaaauccaauuagaaagaaugaaaaaauauggaaaguaccacggcgaauuuauaauagaaaucaaugaugaaaaagaauaccaaucaaauguauucacaacuaaagccuacaaaaaagaacuagaaaaaaucuucgaaacacaacgaugcaacggaaauaaaauaaacacgaaauucaucaaaaaauacauggagauauaugaaaggaaaagagaauacuacauaggaccaggcaacgaaaaaucccgaacagacuaugguauuuacacaacgaggacagaugaggaaggcaacuucauagacgaaaaaaauauuuucggaaagcuaauaggaaaauguucaguauauccggaagaauaucgcgccagcagcgcaucauacacagcccaagaauucaaccugcuuaacgaucuaaauaaccuaaaaauaaauaacgaaaaauuaacagaauuucaaaaaaaagaaauagucgaaauaauaaaagacgcuucaucugucaacaugaggaaaauaaucaaaaaaguuauagacgaagacauugaacaauauagcggcgcacguauagacaaaaaaggaaaagaaauauaccacaccuucgaaauauacagaaaacuaaaaaaagaacucaagacuauaaacguagauauagacucauuuacgcgagaagaguuagauaaaacuauggauauacuaacccucaacacagagagagaaagcauaguaaaagcauucgaugaacaaaaauucguauaugaggaaaauuuaauaaagaaacucauagaauuucgcaaaaacaaucaaagacuauucucuggauggcacucauucucauacaaagcgauguuacaauuaauuccagucauguauaaagaaccaaaagaacagaugcaacuacuaaccgaaaugaacguauuuaaaagcaaaaaagaaaaauaugugaacuacaaauacauaccagaaaacgaaguagugaaagaaaucuacaacccuguaguaguuaaaagcauaagaaccacugugaaaauacuaaacgcauuaaucaaaaaauauggcuauccagaaagcguaguaauugaaaugccucgugacaaaaauucagacgaugaaaaagaaaaaauagauaugaaccaaaaaaaaaaccaagaagaauaugaaaaaauacuaaacaaaaucuaugacgaaaaagguauagagaucacaaacaaagacuauaaaaagcagaaaaaacuaguacuaaaacucaaacuauggaacgaacaggagggccuuuguuuauacucaggaaaaaaaauagcaauagaagaucuauuaaaccacccagaauucuuugaaauagaucacaucauacccaaaucaauaagccuugaugacucaagaucuaacaaaguacugguuuauaaaacggaaaacucaauaaaagaaaacgacacacccuaccauuaccuaacucggauuaacggcaaauggggcuucgaugaauacaaagcgaacguucucgaauuaagacgaagggguaaaauagacgacaagaaagucaacaaucuacuguguauggaagacauuacuaaaauagacgucguaaaaggauuuaucaaccgaaaccuaaacgacacgcgauacgcaagcagaguaguacuaaacgagaugcaaagcuucuuugaaagcaggaaauacuguaacacaaagguaaaggucauaagagggagccucacauaucaaaugcgccaagaccuacaccuaaaaaaaaacagagaggagucauacucucaucaugcaguagacgcuaugcuaauagcauucucacaaaaaggauacgaagcauaccgaaaaauucagaaagauugcuaugacuuugaaacaggugaaauauuagauaaagagaaauggaauaaauacauagaugacgaugaauuugacgacauauuauacaaagaaagaaugaaugagauccgaaaaaaaauuauagaagcagaagaaaaaguaaaauauaauuacaaaauugauaaaaaguguaacagaggacuauguaaucaaacaauauauggaacacgagaaaaggauggaaaaauccacaaaauaagcucauacaauauauaugaugauaaagaaugcaacaguuuaaaaaaaaugaucaacagcggaaagggaagcgacuuauuaauguacaacaacgaccccaaaaccuaucgagacauguuaaaaauauuagaaacauacucaagcgaaaaaaaccccuucguagcauacaauaaagaaacaggagacuacuucagaaaauacaguaaaaaccacaacggaccgaaaguagaaaaaguaaaauauuauucagggcaaauaaacucaugcaucgacauaucacauaaauacggacaugcgaaaaacucuaaaaaaguaguacucgucucuuuaaauccauacagaacagauguguacuaugauaacgauacuggaaaauauuaucuaguagggguuaaauacaaccacauaaaaugugucggcaauaaauacguaaucgacagugaaaccuacaaugaacuacuaagaaaagaaggcguuuuaaacuccgacgaaaaucucgaagaccuaaacagcaaaaacaucacauacaaauucucacuauacaaaaaugacauaauacaauacgaaaaaggaggggaauauuauaccgaaagauuccuaucaagaauaaaagagcaaaaaaauuuaauagagacgaaaccaauaaacaaaccgaauuuccaaagaaaaaacaaaaaaggagaaugggagaauacaaggaaccagauagcucuagcuaaaacaaaauauguaggcaaguuagucacagacguauuaggaaauuguuauauaguaaacauggaaaaauucagccuaguagucgacaaauga

SEQ ID NO: 5081 - RNA, 3324 nt, Artificial Sequence
  Cas9 variant
augggcuauacacuagguuuagacaucggcaucgccucaguaggguuugguuuaauugacaaugucgauggaaaaaucuuagaaaguggagucaggcuauuuucgagcgcagacccagauaauaaucaaacaagaagauccaguagacaagcuagaagacugaacagaaggaaaguacauaggcuagaaagaguagcacaucuucuagaagaagcaggauuugaaaaaggagaagugcuagcaccaaccccguaucaucuacgaguaaaaggacuuacagaaaaacuaagcaaacccgaagucuaugcagcacuauacaaucuaaugaaacacagagguaucuccuaucucgaggauguagaauuagaugaggcugacuccagcagugucucccaaaacguugaacuacuaaaagaauauuaucccugcgaaauacaauuagaaagauaugaagaauacgggcaaauaagagguauaauagaaacauacaauaaagacggagagaaagaaucacugguaaauauauucccaacaggagcauacaagaaagaagcggaagcaauaauacuaaaacaaggacaauuuuacccagaauuagauaaagucuuuuuagaaaaauuuacagaaauacucacaguaaaaagaccauauuacgucgggccugguaacaagaaaucaagaacagacuacgggaucuauagagaaaauggagagacauuagaaaaucuauuugauauauuaauaggcaaaugcacaauauauccucaagaagcaagggcagcaaaauucucauacacagcccaacuauucgacuucuuaaacgacaugaacaacauuucuauagcuggagaaaaauuaacagaaguacagaaaagagaaauauaucaucaaauaauguccaguaaaacaguaaacaugaugaaaauaaucacaaaagugacagguugccuaaaagaagaagucaccggauacagagucgacuccaaauacaaagcugaguuccacucguucgcaagcuacagacaauuucgcaauaaaaugcuugauuacggcuuugauguacaaacacuaaacguagaaauguucgauaaacucgcugccaaacuaacuuuaaauacagaauaucaccaaauaauaacacaacuggagagcuuaaaucuaggauuauccaaagaacuaauagagaaaauagccgauuuucgaaagaaaaaccgaucacucuucucaaaauggcacagucuaucucuaaaagcuaugaaugaagucguagaugaacuauggucaacaagcaaaaaucagaugcaaauuuuuagugaauuaggaggauucaaaucuaacaucgaaguuuuuaaaggacuuaaauauauaccauuagaugcaaugguugaugaaaucuauaacccaguaguaagauguucuauuagggaaagcauuaaaaucauuaaugcacuacuuaagaaauacggugcacuagauaaaguaguaaucgaaaugccaagagacucuaaugaaaaagaagaaaaagaccggaucacgaaacugaauaaagagaaugacaauaaaaagaaacaagccauagagaaagcacguaaugaguacggauucggagaagaagcauacagacaacagaacgaccucaauacaaaacuaagauuaugguacgaacaaaaacaaagaugcuuguacucaggcgaaaucauaaaaauauucgauuuaauuaaaaauccacaucuauuugacauagaucauauuauccccaagaguauuuccuacgacgauagucuaucaaacaaaguauuaugcuacgcaaccgaaaacagagaaaaaggaaaccucacaccauacagauacuucaaaaggaaagcaucacuuacauggaacuacgaggcuuauaaaaguuacgugauagaauuauauaaagacggaaaaggagaccucagcagaacaaaauuagaacuccuacuauuugaagaagauauaaauaaguaugagguaagacaaagauucaucaauagaaaucucgucgauacacgauaugccaguaaagucguacuaaauacuuuacaggacuucaugaaagaaaacuacccaacaacgacaguugagguaguaagaggcaaauuuacugcacaacuucguagacacuggggaauccgcaaaaauagagacgaaaaucaugcccaccacgccaucgacgcucuaauaauagcaugcguaccucaccuaucccuauggaaagaacaaaagaaaguuuuuaguacagacgaauuuagaguagaugaaacaacaggagaaauaaucgaacaaagcuauaaucaacucacauaccaagaacccuuuucacaauucuuuuaccaacuagaaaaagucagcauagauugcagauauuccuacaaaguagaccgaaaauuuaauagacaaguagcagacgcaacaaucuauucuacacgucaaggcauaguaaaacaaacaaguggggacaaaaguuuuacgcuagacagcaacucaaaagaacauuaugugaucgcaaaaaucaaaaauauauaugaagacgucgaugccaagagauucauggacagauacaagaaagacaaaacgcaauuuuuaauguaucaccaugacccacaaacauuuagcauacucgaagauguaaugaaaacauauccagacaagaaaaauccauuccaagcauacagauuagaauauggaccaauacgaaaauauucuaagaaagguaacggcccacaaauucaaucgauaaaauauuaugauucaaaacuaggccaacauaucgaauuaaaacaagccaaccaaucaaccaagaaaguaguacuacagagcuugaaucccuggagaugcgacauauacuauaauaagaaagacaaacgauacauugccgcgggauuaaaauacgcggaccuuucuuaucaaaaaggaaccgguuuauacggcaucagcuuacaacgcuaucaacaaauacucaauucagagaaaauagaacuuucaauagaacaaauagaacuacuucucgaaggaagauugaaugaaagcaauuucgaguucugcuuuaguuuauacaaaaacgauuuuauacaauggaacgaugaaaauaaccaaacauuucaauauagauuucuugcacgaaacuuaucaucaccaaacaggauagaaguaaaaccaauaaauaaaaguaaauacgacaaacaagcagagggacuaaaaacacuaaagaaaggacugaacagguucuacaaaauaucugucgacguacuaggcuaucaacauuuuauaaagaaagaaaaauuaaaacuaacauucaaauga

SEQ ID NO: 5082 - RNA, 3330 nt, Artificial Sequence
  Cas9 variant
augagccacuauguauuaggauuagacauaggaauaacaagugucggguacggcauaauugaucuagauacaaaugacuucauagacuacggcguuagacucuuuaaagaaggcacugcagcaaacaacgaagaccgcagaaacucaaggagcagaagaagacuacuaucccgaaaacauacuagauuaauggacaugcaaaaaguauuaaaagaagcaggaauaaugacugaaucauauucaccacuaaguaauguauaugaaauccguaaaaaaggacuaacuaaagaacugaccaacgaugaacuaacugcagcaauacuacacauaacaaaacacagaggaucaguuaucgaaaccguugaagaugacgaagccgcagccaaagagacuggagaauuaaaauccacucuacacgaaaacgcacuacucuuagcuaauaacaaauucguaugugaaauccaauuagaaagauuaaacaccgaaaauaaaauuagaaaucauaaaaauaauuuuaaaacaaaggauuacguagcugaacucaaagaaauacuaaaccaccaaaaccuuagugaggagguaaaaaacaaaaucauacaaauaguugaacgcagaagagccuacuacgaaggacccggcucauuuaacucccccaccccauaugggagguucauagaaguaaacggacaaguccaagaaauugaccuuauagaaaaaaugagggguaaaugcucugucuacccggacgaauuuagagcaccaaaaauguccauaagugccgaccuuuucaacauacuaaacgacuucaauaaucuacuaguacaaggagaaaaacuacaagaagaagacaaaaaaaaccuauugaaaaucaucaacgacaaaggaucuauaacccuacgacaaauaucaaaaaaauuggaaguuaaugaagacgaaauaaaaggauaccguauagacaaaaaaggaaaagcacucuucacugaauucaaaggauacaagaucuuaaagaaacuguuuuuaaauuguggacaaagcauaucacuggaggauuaugaaaugcuagacgaaauaaucgagauaguaacuaaaaaaaaaggaaucgaugaaagaaaagacgcacuaaaagaacucaaaugggacuuaagcgacgacauaauuaacucauuaagugaaguaaccggcauaguaggcuaccauagccuguccuuaaaagcaauacgagaacuggauucagaacuauacaaaacaucauuaaaucaaaugcaauuacuucacgaacugaaaauguucgauaaaaacagaccaagcuauaaaggcaaaaagaacauaguugcagaccccgaagcaauauuaagcccagucgcaaaaagagcacaaaacgaaacauucaagguuauuaaugcacuaagaaaaaaauauggagaguucgacagcauagucguagaaaugacuagagauaagaacucacaagaacaaaaaaaaagaaucaacgacagccaaaaagcauuagaaucgcuaaacaaagaaguagaucaacuacuccaacaaaagggcuacgauccacaaaaagucaaagggaaaacaaaacaaaaggucagauuauauaugaugcaagaagguaaaagcgcguauacauuacaagaauuggauuuacacagagugaucaaagacgacaaauauaccgaaauagaccauauaauaccaauaagcauuucauuagaugacagucaaagcaauaaaguacuugccuuacacagcgaaaaccaacaaaaaggaaaucuaacccccuucauggcuuuucauaccggaagauucgcggacaugggcugcacguggaauaaauuuaaagaaaauguacuauccaacaagaacuacaaacauaaaaaaaaaaacaacuuacuagaugaacgagacauaaacaaauucucaguaauacaagaauuuauaaaccgaaaccuagucgacacuagcuaugcaaacagaguaguacuaaacacucuuacagacuauuucaaagacaaugaaauugauaccaaaguacauacaguaaacggaaaauuaacggauuuauuuagaaaaagaauaaaccuaaaaaaagauaggaacgaagacuaucuacaccacgcaauagacgcccugauagucgcaagcaucaaaaaacuaagacucuuggacggauaccuagcaaaauauggcuucgaaacacuauacgacgaaaugacaggagaaauaaaagaaauuccagaagauaaagcuuuuuuugaugacaaauacauacgauauauauuaaaccucaaaacaaucuaugaaaguagcaacauguacuauagaggaauacuagaaagagaagaauuaauauaccaacccauaaaaauaucacauaaaauagauaccaaaccaaaucgaaaaguuucagacgaaaccauuuacucgacaagaauaauugacaacgaggaucaccuaauugaaaaauauucagacauauacgacccaaaauuuaaaaaccucacagaagauauccuaaauggagaaaagaauaaauauuugauggagaaaaaugauccccaaacguucaauauacuaaaacaaauaauauucaaccacuacaacacuuacaaggacucaaaagaauacuauaaaauagagaaaaagaaagaaaaagaaauaauaaaacuaguaggaauuaacccccuuucuuuauacaaagaagaaaacggccccauuaaaaaauacucuaaaaaagguaacggaccaguuaucaugucaaugaaguacgacucugaaaaauuaggcaaccauauugauauaacaccagacuccgcgaaaaauaaaaagguuauccucaaacaaaucagccccuaucgaacagauuuuuauaaaugcagcgacgaaaaauucagauuuguaacaguacgcuacaaagauguacauuaucaaaaaucgauagauaaauacugcauugauaaggaaugguaucaaaacgaaaaaaaaaacaaaaaaauagacgaaaaagcagaauuuuuauuuuccaugcaucaugacgaacuaauagguaucacuagaaaagaaucggaacaauucaucuacgacgaaucuaaagagaaccacggagacccgcgauaccacgacggaguaaaacccgaaauccuaaaauucacagcuaccaauaaugauacuaaaggaaucauugaagucaaaccacuauauaccuauucagcuuacagacuuaaaccuacuguacuaaacgugaaaaacauaaaaaaauacgcaaccgacguauuaggcaaccucuacgaaguaaaacaaaacgaacucaagcuagaguuuuga

SEQ ID NO: 5083 - RNA, 3333 nt, Artificial Sequence
  Cas9 variant
auggcagaagguaagaaacgaauauggagacuuggcgcggauuuaggugcaaauucccugggaugggcagcaauagaacuuagugcaccaguaaauggaaaaccaaucgcaaucuuggcagcuggcucaaggauauucucagauggacgugauccgaaauccggagcaucauuggccguugacagaagagaugcaagagcaaugagaagaagacgagaccgauucaaacaaaggcaaaaggcuuuaauaaaguauuuaauugcugacggcuuauuuccagcagaugaagcagcacgaaaugcuauggcugcgauagacccauacgcaguuagagcacgagcacuagacgaggcuuuaucacuacccgaauuggggagagcucuuuuccaucuaaaucaacgacgaggauuuaaaucuaauagaaaagcagauagaaaagcggacgaugacgcaggaaagauagcaauaggaauagaucgcacaagagacgcaauagcagaagaugaagcagacgcaggagcagaaccuggaagcuggacauucggcaaguggcuucaugagagaagacuaaaaggacaaaguguuagaacaagacuucgcccagaaucaggcgaagacgccaaaggagacggcuaugauuuuuauccagaccgugcucucauggaagaagaguucgaugcaaucugggcagcacaagccccucaucauccagauguccuaacaaaugauguccaugauagauuacacgaaaucauauuuuaucaacgaccccucaaagcgccacaagucggaaugugcucgcuaauuccuggagauagaagacucccaaaagcccaucccuuauuucaacgccgaagguuacuggaagaacuaaaugcccucaugauaguacgaccaggagaaguugcacaacgucuaacaagagaagaaagagacauacuuuuacuaaaacucaaagauaaaaauaaagucucuuucgcaacucuaaggaaagcucuaaaacuagaucccgaugcaagauuuaauaaagaaagugaagacagaacagauuuaaaaggggaugaaguagcagcuguuaugggaucuaaaacaagauucggaaacuuauggguucauuuaaguauagaagcucaaugggauguacuagcaagacuagacgcaguugaaagcgaugcggaagaugccgcuuucugugcaugguuaguugaaacguaugcgcugacaccagaacaagcaagggcaguagcaaaugcgccuuuaccaccaggguacggccgguucggagaaacugcgacaagaaaauuaauugaagcacuaagagacggaaagaaggacgaucgagucuuaguauacagugaagccgucacugaagcuggcuuaggccaucauagcgacagaagaacaggagaaguauuugaagacgcgaaaggaaggccgcaauugcccuauuauggaguggcauuagaacgacacauaaugccagggacaggagauccaagcgacccagaagagaugcgagucggccgacuaacuaauccuacaguacauauuggacuuaaccaguuacgaagaauacucaauguacuuauaagagcguauggaccgccagcagaaauugcaaucgagcuggcaagagaguuaaaacuaacagaugaagauaagaaaagaauaaacagagagaacaacgauaauagaauagcagcagagagacggagcgaaaaauugcucgcaauaggacaagcagacucuggagcaaaucgagcauuacugaaacuaugggaggaacuaaauccagcaaauguacuagauaggagaugcauauauaguggaagacaaauaagcaucgacaugcuuuucucagcugcuguagaaguggaccacauacuucccuuugcugcaacacuagacgauuccaauggaaauaaaauaguuuguuuacgagaagcuaauagagagaaaagaaaaaggaguccacacgacgcaugggggcauagugcacgaugggacgaaauagcagccagagcagcucaacuaccaagaaauaaaagauggagauucgaaccagaugcaauggauaaauucagagaugaaggugguuuccaagcucgacaucucguagacacacaauaccuagcacgacuaagccgagaauauuuagccacguuguauccagaaaaaggagaaggcucaggacauauuuggguaucgccaggaagacuaacagaaaugguacgaagaaaauuagguuuaaacgaccuguuaccggaucacaacuuuggaggaggagcggaucaagcgaaaaacagacucgaccauaggcaucacgcaauugacgccguagucguagcgauaguggaccggggaauguugaacgcuauagcaagggcuaguggucaagaaggagcugaaggaagagaaagaauaauaauuccagagccaugggacggguuuagagacgcucuacgagagaccguaaaucgcaucaccguaucacaucgcaccgaccacggcacagcaucaaaagcaggauuaccaaaaggaaaagacgcaacagcaggacgauuacauaaugacacagcauauggauuuaccggagacacggaugcaaaagguaauagcaucguuguaagaagaguaccacuaucaaguuucaagaaauuagcggaucuagaucguauacgagaugcagaucuaaaagccgcauuguaucaacaucuaaacggacuagaaggaaaagcguuugaaaaagcauuggcugaguuccauaaauuggaauggcacaauuuugguggcguaagaagagugagaguaacugagccauuaacaguuauuccaauaaaagauagaaauggaagaaucuauaaaggguauaaaggugacucaaauuacagguaugauguaugggaacuaccugacggcaaaugggugaccaauuggaaaaacgaagcaggggaagcaaugaguaguguaauauccauguuugacgcacaccaaucaucagaacccccaagaccacacccagcagcaagaaaaauauuaagucugcaucaaaaugaccuauuagcuauugaaagagagggagaagauagaaaacuuaugcguguaguuaaauucggacaaagcgggcagauuacacucgccgaacaccaacaagcaggggaucuaaagaaacgagaugcaguaagcaaugaugacgacccuuuuaaauauuucgcaccgacaaguggaggcuugaagaaagucaaagcgaggcaaguaagaauagacgaaauagguagaguacuagacccaggcuuuccggcaagaacugcgagaagaaaaacgcgaggguga

SEQ ID NO: 5084 - RNA, 3333 nt, Artificial Sequence
  Cas9 variant
augacggcaagaacucauaaaauauggcgauuaggggcugaucucggagcaaacagucuuggaugggcagccauagaacuaucggcaccuguagauggaaaaccaaucgcaauacuucaugcagggagccgaauauuuucagacggcagagaucccaaaucgggcgcuucauuagcaguagauagaagggaugcgagagcuaugagacgaaggcgagaccggcuccaacagagacaaagagcacuuauaaaauacuuaauugcagauggccucuuuccagcugaugaaaacgaaaggaaagcaauggcaacaauagauccauacgcaguccgcgcaagagcacucgaugaagcucuaacguugcccgaagucgggagagcacucuuccauuugaaucaaagaagaggauuuaaaaguaauaggaaagcugauaggaaagcugaugaggacgcgggaaagauugcgauuggaauugacagaacccgagaugcuauucgacaagcagaagaagaagccggugcugaaccaggcucauggacauaugguaaaugguuguaugagaggagagcguccgcaacagacgcaaaugcaauaccaucggugagaacgagauugagaccggaaacugacgaacacgcuaaaggggauggauaugauuuuuauccugggagagccuuaauggaagcagaguuugcagcaauaugggaagcucaagcagcacaucauccagacgcguuaacaaaugagguacaugauagauuacacgaaauaauuuucuaccagagaccuuuaaaagcaccgcaaauaggaguauguacauuaauaagaggagaucaaagacuuccgaaagcacacccccuauuucagaaaagaagacucuuagaagaauuaaaugcauuaacaauaguaagaccuggagagauggcccaacgucugacaagagaggaacgcgacacacuauucuugaaauuaaaagauaaagccaaggugucauuuguaagucuaagaaaaacacuaaagcuagacccugacgcaagauucaacaaagagucagaaaaucgauccgauuuaaaaggagacgaaguagcugcagcaaugggugccaagacgagguuuggaaauagaugggugcauuuaaguauagaggaacaaugggaugucauagcgcgucuugaagaaguagaauccgaugcagaagacgcagcauguagagcaugguuagccgcaaccuuugauuuaacaccagaacaaaucagagcaguaacuaaugcuccgcuaccaccagguuauagcagauuugguaaaguggcaacacaaagacugauugaugcacuccgggacggagaaaaagaugguagaguauuaguauauucugaagcuguagcggcggcaggauuaggacaucauagugaucuaagaacaggugaaauauuugaagaugcccaaggacggccacaacucccauauuauggaguugcacuagaacgacauaucaugccgggcacaggaaaucccgaucauagugacgaaaugagaauugguagacuuacuaacccuacaguacacauaggacuaaaucaauuacgaagaauaguuaauacauugauacgagcauauggaccgccggcugaaauugcaauagaacucgcccgugaacuaaaauugacagaugaugacaagaaacguauuaauaaagaaaauaaugaaaauagauuagcugcggagaaaagaagugaaaaauuauugacaauaggaagaccagauacaggagccaaccgagcauuacugaaauuaugggaagaauuaaauccugcaaacguguuggauaggcgaugcauauacacgggcacccaaauaagcguugauauguuauucagcgccgcugucgaagucgaucauauacuaccuuucaccgcaacauuagacgacucgaaugggaauaaaaucgucugcaugcgagaagccaauagaacaaaacgaaaacaaucaccauaugaggcuuggggucauacugacagaugggaagaaauagcagcaagagcagcacaacuaccuagaaauaaaagauggagauucgaaccugacgcaauggaaaaauucaaagacgaaucaggauuccaagccagacauuugguugauacacaauaucuagcuagauuaucaagagaauauuuggaaacacuauauccuggaucgggagaaggaaguucacauauaugggugagcccugguagauuaaccgaaaugguuaggcgcaaauuaggauugaaugauuuacuaccugaucacaacuuugggggaggugcagaucaagcgaaaaaucgucuugaucacagacaccaugcaauugaugcaguaguaguagcgauaguggacagaaguauguuaaccgaaauuucaagaguuaguggacuagaaggagcugaagguagagaacgaauaaucauaccaccaccaugggaugaauuuagaaaugaucuuagaacugcagugaacgcaaucacagucagucacagaaccgaucaugggacaauaaguaaagcugguuuacccaagggcaaagacgccaccgccgguagacuucacaacgauacagcguacggauuuacaggugaaacggacgcaaagggcaauuccauaguaguuagaagaguaccauuggcuucauucaagaaacuggcagaucuagacagaaucagagauacagaucuaaaagcagcauuauaccaacaccuugaaggacuugaagguaaagcauucgaaaaagcugugauggacuuucccaacuuagaauggcauccuuuuggaaaugugcguaggguacggguaacagagguauuaaguguaauuccgauaucugaccaaaaugguagaauuuauaaaggauacaaaggggacagcaacuauagauaugacgucugggaauuacccggaggaaaaugggaagcugaaguaguaagcacuuucgaugcgcaucaaccggacuggguaucaaaaauaagaagucguaguccuacagccagaaaaguccuaucauuacaacaaaaugaucuuauagcaguagaaagagcgcacgaaacuagagaacuaaugcgaguaguaaaauuuagacaaaauggagaaauuaccuucgcaccgccacaagaggcaggaagucugaaaagaagagaugccacucccaaugaagacgacccauuuaaauacuuugcuguugcagcaucaaguuuacaaaaagccaaagcuagacaagugagaauagaugaacugggaagaguauuggaucccggauuuccagcacgaacagcgagaagaaaaacaagaaaaucaacauga

SEQ ID NO: 5085 - RNA, 3333 nt, Artificial Sequence
  Cas9 variant
augaggauacucggauucgauauaggaauaacaucaauaggaugggccuacgucgaaggggaagaauuaaaagacuguggaguacgaauauuuacaaaagcagaaaacccacaaaauggcgacucccucgcagcucccaggagagaggcaagaggcgugagaagaagacucgcacgaagaaaaguacgacuaaauguaauaaaacggcuacugugcaaagaauuugguuugaaccuaagcgauuacuucgcaaacgauggagaauuaccuaaagcauaugaaacaacuaaagauaccaaauccccguaugagcuuagaucucuagcguuagaacaaaaauuagaaccaaaagaacuagcacgugugauucuucauauugcaaaacauagaggauacggcaauaaacaugcaaaaagggaucuggaggcugaagagaaagcaaagaaagcugccgaaaaagcaccacaagaaaaagaaaguacaacaacaaauggagacucaaagaaagaacaagaaaaaguacuaaaagcauuauaucaaaacgaaacucuccuaaagaaauaccaaacaaauuaccaaacuaacaauaaaacuaacgaugagaccaacaacaaaaccauauuucuagugggaaaauacuuauacaaagaguuccaagauaaaggacaaagaauuaggaacacaaccaacaacuaccaacacaccaugagacaagaauggcuuaaagaugaacuagaguucaucuucaagaaacaaaaagauuuuggagcuacauucagcgaaaacuuugaaucacaaauccucgaaacagcauucuaccaaagagacuuaaaaucauucgaagauaaaguaggaaaauguguauucuacgaaaacgaaaauagagcgccaaaagauucacugucggcuauggaauuuguagcauuaacgaggauaauaaacacauuaaagaaucuagaaaagaaaaguaaaaacuuaggcauaggcgaaacuuauggcaaagauaaaauacaagaaauacuaaaaauaguauuggacaaaggcgaaaugucauacaaagaacuacgaaaaauauuaaaacucaacgagucgauacuuuucgcaaaagacagcaaacuugauuacacgaaagguaugcaagaggcagaaaaagcuaaauucauagaauuaaagaauuuaaaagcauucaagaaagcuaugggaggagacuuuagcaaauucccaagagaagaacuagacaaaauugcuacagacauaguacuaauaaaaucaaaagaaaaccuagcaaagaaacuacaaaacuauagugcacuaucaaaagaacaaguagaagcacuaucaaaucuaaauuuugcaaaacauauagauuuaaguuuaaaagcccucgacaaaauacuacccuuuaugagagagggcuuaaguuacgacgaaguuguaaagaaagucggacuccaagaacacagaaaauauaaacaaaaaggcgaguuuuuaaucccauuaaaagaauacgaacccuaucuagcaaauccaguaguagcacgagcacucuccgaauacaggaaagucuuaaacgcgcuguuacgaaaauacggaaauguacacaaaauacaucuugaauuuaccagggaagcagguaaaaauuacgaugaaagaaagaaaaucgaaaaagaacaaagagaacacuucgaagccaaucaaaaagcgauaaaacaacgcgaaaucuuaggacucccaauaaacggcgcuaacauauugaaaaugaaacuauggauugaacagggagaaugcugcguauacucaggggagaaaauaacaagcaaacacuucuucgauucaaacgccuuacagguagaccacauauacccauacuccagaaguuuugacgacucguauaugaacaaaguacuggucuucgccaaagaaaaucaaaacaaacuaaacaaaacaccauucgaagcauuuggaagcgacaaagagaaaugggacagaauuuuaucguuaucagcgaaacuuccgaaacagaaacaaaggagaauaucaaauaaagacuuuaaagauaaagaauuaggguuuauagcucgaaacaucaaugauacaggauacauagcaagacuagcgagccaauggacaaacaauugcuuaaaauucgaggaucuaagggaaaaugagguuacuauagcaggagaaaaagggaguaaaaaucaucucgaagucauaucagggcaauuaacuucuauguuacgacacuauuggggccucggcgauaaagacagaaauaaccaccuucaucaugcuguagaugcaguaaucauugcauauacuaaugcaaaaacaaucaaggcuuuugcugauuucaagaaaaaccaagaacaaaauagagcuaaauuuuacgcaaaacagauaucagaacaggaauacaaaagacaacgaaacccuuucgaaccuugcgcaaacuucagacaacgaguagaagagaaaauaaauaaaaucuuugucagcaagccaccacgaaaacgagcacgaggagcauuacauaaagaaacauucgguagcaucugcuuagacggcaauaauaacuggguagcgagauuuaagaucaaaaguaagaaagaacaagaagauauuacaaaagaaaaagcuacgaaagcgaaauacaaagacgaguucaaaggagaagaaaacauacgaaaagcgcuaaaacuuggaaaaaucaggagaauuaacaacacccaaaaagauauugcaauuggagacaaaauagucaaaaacgaaacgaugguaagaguagacauuuucaaagacaagaaaggaaaauucuaugcaguaccuaucuauacgauggauuuugcacuaggcauccucccaaacaaagcaguagcaacaggagaagaugaagaugguguaauaaaagacuggaucgaaauggacaaaacuaaauacgaauuuuguuucucauuauuuaaagacgaccugaucaaaguacguaaaaagaaaaugaaagaagcagaacuaugcuauuucguuggauuugauacagacgguucaagaauaauuguggcgaaacacaacaaugauuaucaaacaaugacggaaaaugaaugcaaacuauucacacuaaaagaaaagaaaaagaaacagaaaacauuaaacgacgaagaagauaaccaagaaagaauagaaaccgaauacaaaauaauaggaggaagaacaggaauacagaaccuugaaacauucgaaaaacaccaaguaucaccacuaggagaaguccaaaaagcagaguucgaagauagacaggaaauaaaauugaaauccucuccaaaaggcaaagauuga

SEQ ID NO: 5086 - RNA, 3333 nt, Artificial Sequence
  Cas9 variant
augucagagaaauaucgcuuaggacuagauguugggacaaacucucuaggaugggcaguaauaggacuaaaggaagacguacccucuucaguauuagcaacagggguaagaauauuuagugaaggaagagacgccaaaacgaagucaacuuuaaaagcuagucgaacagagaaacguucagcaagaagacgacgagaucguuuucuacaaaggcaaacauuuuuaauauccgaaaugguaaagucaggguuguuccccaaagauauaguagaacaaaagaaccuagaauuauuggauccauaugaaaucagauuuaaagccuuaacagaacaaguaccgcuucaccaccuagguagagcacuguuccacauaaaccaaaggcgugguuuuaaaagcucaagaaaagauaaaagugaagaaacaacaucagguguaguaaguaagucagucagagccuuauaugaagaaaugcaacugauaaauccagcgccaguuauagaugauccuaaagccuugaguaaagaagaacguagagaaauaagaguacaagaagcauccagucgugaagaagcauuaguaacccuagcagaacaaaaagguguaaccuuuggugcauuucuauacagaagauuacaaagcgguaaaagcguucgagcucguaaagaugcagauucacaacuuuaugauguauaccccacacgagaacuucucaaagacgaauauagcaaauuaaugcaacaucaggcccaguacuacccuaauguaauuaacgaagcacuaauaucaagacuacacgacguaauuuucuuucaaagaaaguuaaaagaacaagaaagagguuucuguacauacuacccuucugaaagacgaaccuuuagauguaugccaucguuccaacaauaccgaaugguacaagaacuaaaugcauuagaaugggucgaugcggccggaaagcauuguuuacgagacuaccccgaaucuagagacuuaauacuaucugaauuagaaaauauaaguacaaaagcaggagaguucacauucgguaacaugaagaaaauauuaaagaaaauggguguaauagacggagaaguuagcuucaauuuugagggacccaaaagaaaaggauuccagggaaacguaacaucucgcgaaaugcgacaugaagacugcuucgguacuagaugggaugaacuaucacuagaugaaaaagacgacaucauugacaaaauaaaugaugaucacuuggaugacgaagauauggaaagguaucucauagacacauauggacuaucaucauuuaguguaggaaaugcuauaaacgcccgccuccucgaaggaacagcaaacgugucaaggaaagccgcaagaacauuauaugaaacaaugcucucggcgaauugucuucaaucagaugcagucauagcaguaucagaacaagaugauacauuuguaaauccauauagcagaacaggcagaggugaacuacuaagugaguuaccauacuauggagaagcauuucaagaugguagacauauaauaccagguaaaagagaaccaaaggucucacaugaucaacuaaaauucuauggagguguuaguaauccuacuguucauauagcucuaaaucaaauaagauuaguaguaaacgaaaucaucaaacguuauggucuaccgucaucuauuaguauugagcuugcuagaaauuuaccagaaggacaggauggacggcggaaaauagagaaaaugcaaagcgaaaaucagaaaaacaaugaaagauacgaccaaauuuuaacagaaaacggacaaagcccuaaucgggacaaucggcuacgacucgcccuaugggaagaauuaggcgaagguccaacugacagauuaugcguauuuacaggaaaacuuauagaauuagcagacuuauuuaacgguucuguagaaauagaacauuuaauaccauuuaguguuagucucgaugauucaaaagcaaauaaaacagucuguuggaaagaagcaaauagauuuaaaggaaacaagaccccauaugaggcauuugcaaauaacagcggagauuauucaugggaagagauaauggaaagaguaagagcauuacccaauucaaaacaauggagauuucaagaggaugcacuaaaaauuuggaacucagaucauucagauuuuucuggacgacacuuaaaugacacuagguauauaagccgacuggcaagagaauaucucgaaaauauuuguccauucaauaagauagacgucguuacaggaagauuaacagcacuauuacgaggacauuggggucuuaauaauauacuacggggucauaacgaaccggaaacagcuacaccuaagaaaaugagagaugaucauaggcaccaugcuauagaugcuguaguaauagcaaugacaucauuaacgauauuacaaaaaguuagcagcgcugcaggcaaagcagaggaacucgauguaggaaaauuauucgcaaaagaugaaaguggaagaagcguaauagacccaugggauggcuucagagacgagguggcugaaaaaguucggaauauaauaguuagccauaaaaccaaaagaaaaacuauaggcaauagcggaaaaucaacagauagagcgcuacacaacgaaacggcuuaugguuugauagacggaccggacgagaagggacuauacagcguaguuaccacaaaaccaauuuccuacuuugauaauagagacaaaauagaaaagauaagagaugaaaaauuaagagacgauuucuuaaccgcaugggauggagaaggugacaauaaagccucucaauuagcuguauuagacaaagcaagcggucuaaauguaaagaaaugucgauaugucgaaagaaagaaaguuauccccauuaauggacccgauggacaaccauacaaagccuaugacggaaauaguaauugggguauggaaauuuaugaguucccaaauggacauccuaaagaaaagaaauggaacggaguaguuauuagcacguacgaugcuaauaaaucagaauuuaaaccaggagaaacauucagaccacacccagcagcaaaauuaguaaugagacuacauauuaaugauauaguagagguacaaaacgacggagaaccuauauuauaucgaguacaauuaauaucggcaggaacacucacgguuuccccauuacaugaagcuaacguagauagcagaaaucgagacaaacacgacgaauuuaaauacaaaucauuguccguuaccccgaugcagaaaaugggagcgaagaaaguaaauauaucaccaacaggacuuaaaaacuauuccagguga

SEQ ID NO: 5087 - RNA, 3345 nt, Artificial Sequence
  Cas9 variant
auggguauaauaauaggacuagacauagggaucgcuaguguaggaauugcaguaguggacaaagacacccuagauauaaaaugcgucguaagugacuuguucgauucagcggaugcuagcaaaaauauagaaagaagaaacaauagacaagccagaagauuaaauagaagacgaaaaacuagaauuggagauuuuaauacccuauggguaucaauguuuggagagcucccagaagaaguugauucaaaugucuuacuacuaagaaaugcaggacuagacgaacaacuaacacuagaugaaauauauugcguccucaaguauaugcuaaaacacaggggaauaucauaccuggaagaugcucuuaaugaagaaaacguaacaggaaguuaccagaaagggauugcaauaaaccagagagaauccgaguacaugcuaccuugcgaaauacaacuagaaagauuccgaaaauauggacaauacagaggagaaugcgaggcagaaaacgaaaacggugaaaagauaacccuaagcaacguauuuaugacuaauucauacagaaaggaaauagauaaauucuuaaauacacaaggaaaauacggaauacuaaaccaaaaauucauagacgaauaccuaaaaauauucaaucggaaaagaaaauacuaugaaggaccugguaaugaaaaaucaagaaccgacuacggaaaauacacaacaggaaaagaucuagauggaaaauacauaacggaaaaaaacauauucgaaaaauugauaggcaaaugcuccguauacaaagaagaauuacgugcagccggagcguccuacacagcacaagaauuuaauauucuaaaugaucuaaacaacauaacagucaacaacaaaaaacuaacaacucaacaaaaaaaagacgucauugaaauaguacaaaacucugaccgcauuaacauggaaaaaaucauaagcagcugcauaggagaaaaaaucgaaaaaauagaaggagcccgaauagauaagaacgaaaaaaauauauaccacaccuuugaacaauauaacaaaaugaggaagaucuucgcggaaaaaaacuaugacauaaaagaacucacaauugaacaacuugacgagauugguagaauacucacaauuaacacagagagagaagggauuaaggaugcaaucauggaaucagaacuacuacaccucaauaacgaacaaaucaaccuucucauagaacuaagguacaaaaauucaucacucuucacaaaauggcaaagccugucaauuaaagcaaugagagaaauaauaccugaccucuaugauagaaaugugaaccaaaugaauauacuugccgagagaggaguauuuaaggacaaaauuaaucuguucgaaaacuccguauaucuaccaaaagagccaguacuagaagaaauauauaaccccgugguucgaagaucaauaucuaugaccauagacgcauugaacgcacuaauaaaaaaauacggauacccugaagauaucguaaucgaaaugccaagggacagaaaugacgcagaacaaaaagacagaauaaaaaaauuccaaaaaacaagagaaaacgaacuaaaaaacauaaagaaaaaaauaaaagaagaauauggcauagaaauaacagacgaauacuuccgcaaacacaaaggauuagaacuagaacuaaaacuguggguagaacaaaacgaaaaauguccauacucaggaaaauacauaaacguacaagauauacucuaccaccaugagcucuuugaaauugaccacauuauaccccucucuauaucauacgacgacucaagaaauaauaaaguacuaguauauaaagaagaaaaccaagacaaaggaaaucgaacaccucuaauguaccuauccacgguaaacaggcaauacgaccagcaugaauucaugaacuacguguuauccacaaaaacacuaccacgcaaaaaacgagaauuauuauuaaacuacgaagacauaacaaaaauagauguacuuaaaggauuuauaaauagaaaucuaaacgacacgagauacgccucaagaaguguuuuaaaugcaauucagcuguucuuuggaggcaaagaaugugacacaaaaguaagaguaaucaggggagccguuacaaaccaacuaagaauaaaacuaaaucuaccaaaggaccgcgaaaaaagcuacucucaucacgcuauagaugccgcaauuauguguuauucgcaaaugggcuuaaugaacuucagaaacauccaaaacaaauucauagauuucgaaaacgaaacauacuuaagugacgaacgcgacucgugcuucgauaacaaauacuacgacgaagcacuauuuggacaaguguuaaaaaugaggaaaaacuuauuaaaagcagaggguaaaccacaaagaaguguacaaucaaaaggaguauucgacgaagaagaaaaaaacaacggaauuguacguuaucaucauaaaguggacaaaaaaccaaauaggggucucucuaaugcgucaauauacggaacccgcaaaauugacgacaaaauauauaaaauaguaggauaugacauaagaaauaacaaagacgcagaagcaaucaucaauauuauaaaaaaagggaaaagcgauaauuucuugauggcaaaacacgacccagaaacauuuaaaaauuuaauggaaauuuaugagcaauacaaagaagaaaaaaauccuuuuuuggcauacgaacaggaaaccggagauuacauaagaaaauaugcuaaaaaccauaauggcccaauaauuaaaaaaauuaaguacgucgauuccgagguaggaucauguaucgacauaagcgcaaacuacgguuauaaaaauggagauaaaagagucauaauggauacacuaacaccauacagggcagacguuuauuacaacuacaaagauggaaccuaccgaauaauaggaguaaaauaugcggacuuuaaauacaguaacgcaaaauacguacucgaugaagaagcuuacgcccuaauacuaauaaaagagggauuacuuaagauaggcgauagucuugaaaacauaucaagcucuggauaugaauacagacuaagcuucuauaaaaacgacauaaucgaauauaccaaaaacgauauaguauauaaagaaagauucuuaagucgaacaaugccaaaaguaaaaaacuauaucgaaacaaaacccauuucagcggcauuauacgaaaaaagaaacccaaucggacuaaccaacgcuacgaauauauguaaaauuuacacagacguccucggaaaugaaacaaagaucuacaaagaaaaauucaaacuuucagucgauuga

SEQ ID NO: 5088 - RNA, 3345 nt, Artificial Sequence
  Cas9 variant
augaauuauacagaaaaagaaaaauuguucaugaaauauauauuggcacuagauauaggaauagcuucagucggcugggcaauauuagacaaagaaucugaaacaguaauagaagcagggagcaauauuuucccagaagcgucagcagcagacaaucaauuacgucgagacaugagaggagcaaaaagaaauaaccgcagauuaaaaacaagaauaaaugacuucaucaaacuaugggaaaauaauaauuuaucaauaccccaauucaaaucaacagaaauaguaggauuaaaagucagggcaauuacagaagaaauaacgcucgacgagcuauacuuaauacuauacagcuaccuaaaacauagagggaucagcuauuuagaagacgcgcuagacgacacaguaucagguucuagcgcauacgccaaugguuuaaaacuaaaugcuaaagaacuagaaacacacuacccuugcgaaauacagcaagagaggcuaaacacaauaggaaaauacagaggacaaucacaaauaauaaacgaaaauggagaaguacuugacuuaagcaaugucuucacaaucggagccuacaggaaagaaauccaaagaguauucgaaauacaaaagaaauaccacccagagcuuacagacgaguucugugaugguuauaugcucauauucaaccgaaaaaggaaauacuacgaaggcccuggaaacgagaaaagccgaacagauuauggacgauuuacgaccaaauuagacgcaaauggaaauuauauaacggaagacaauauauuugaaaaauuaauuggaaaaugcaguguauacccugacgaacuccgagcagccgcugcaucuuacacagcccaggaauacaacguacugaaugaucuaaauaaccuuacuauaaacggcagaaaacuugaagaaaaugaaaaacacgaaauuguagaacgcauaaaaucaagcaauaccauaaacaugagaaaaauaauaucggacuguaugggcgaaaacauagacgacuuugcuggcgcacguaucgacaaaucagguaaagaaauauuucauaaauuugaagucuauaauaagaugaggaaagcauuauuagaaauaggaauagauauaaguaacuacucaagagaagaauuagaugaaaucggauauauaaugacaauaaauacagacaaagaagccaugauggaagccuuccagaaaucuuggauagaccuauccgacgauguaaagcaaugcuuaauaaacaugagaaaaacaaauggagcucucuucaacaaauggcagagcuuuucacuaaaaauuaugaaugaacuaauaccugaaauguacgcacaaccuaaagaacagaugacauuacucacagaaaugggaguaacaaaaggcacucaagaagaguucgcaggccuaaaauacauaccaguagauguagucagugaagacaucuuuaauccagugguuaggagaucaguaagaauaaguuuuaaaauauuaaacgcaguucuaaagaaauauaaagcacuagauacaauugucauagaaaugccaagagauagaaacagcgaagaacagaagaaacggauaaacgacagucaaaaacuaaacgaaaaagaaauggaauacauagaaaagaaacuagcaguaacauauggaauaaaauuaucucccagcgacuuuuccagucaaaaacaacuaagucuaaaacuaaaacucuggaaugaacaagauggaauaugcuuauauagugguaaaacaauugacccuaacgacauaauaaacaacccacaacucuucgaaauagaccacauaauaccccgaucaauaaguuuugacgaugcaagaagcaacaaagugcuaguauacagaagugaaaaucaaaagaaaggaaaccaaacaccauacuacuacuuaacacauucacauuccgaauggucauucgaacaauauaaagcuacaguaaugaaccuaagcaaaaagaaagaauacgcuauauccagaaagaaaauacaaaaucuacuauacucggaagacauaacaaaaauggauguacugaaagguuucauaaacagaaacauaaacgacacaaguuacgcaucaagacucguacuaaauacaauacaaaacuuuuucauggcuaaugaagccgacaccaaaguaaaaguaauaaaaggaucauacacucaccaaaugcgcugcaaccuaaaacuggacaaaaaccgugacgaaaguuacagccaccacgcaguagacgcaaugcucauaggcuauagcgaauuaggcuaugaagcauaccacaaauuacaaggagaauuuauagacuucgaaacaggggaaaucuugcgaaaagauaugugggaugaaaacaugucagacgagguguaugccgacuaccuauaugggaagaaaugggcaaacaucagaaaugaaguaguaaaagcagagaaaaaugucaaauauuggcacuaugucaugaggaaaucaaaucgaggauuaugcaaucagacgauaagaggaacaagagaauaugacggaaaacaauacaaaauaaauaaacuagacauaagaacuaaagaagggauuaaagucuucgcuaaauuagcauuuagcaagaaagacucagacagagaaagacuccuuguuuacuugaacgaucgccgcacauucgacgaccuguguaaaauuuacgaagacuacagcgaugcagcuaauccauucguacaauaugaaaaagaaacaggagauauaaucagaaaauacagcaagaaacauaaugguccgagaauagacaaauuaaaauacaaagauggagaaguaggugccugcauagauaucagccauaaauauggauuugaaaaagguucaaagaaaguuauucuugaaagccucguaccuuaucgaauggaugucuacuauaaagaagaaaaccauaguuacuauuuagucggcguaaaacaaucagauauuaaauucgaaaaaggacgaaauguaaucgacgaggaagccuacgcaagaauccuaguaaaugagaaaaugauccaaccuggucaauccagggcagauuuggaaaacuuaggauuuaaauuuaaauuaaguuucuauaaaaacgacauaauagaauacgaaaaagauggaaaaauauacacagaacgucugguaucaaggacaaugccaaaacagagaaauuacauagaaacuaaaccgauugacaaagcuaaauuugaaaaacaaaauuuaguuggccuugguaaaacuaaauucauaaagaaauacagauaugacauacucgguaacaaauacucuugcucagaagaaaaguucacaucauucuguuga

SEQ ID NO: 5089 - RNA, 3348 nt, Artificial Sequence
  Cas9 variant
augagcgccacauauacaauuggccuggauauaggaauagcaaguguaggcuggugcgcauucggggaaacacacauccuagaucucgguguaagggcguuugacaaggcagaaacugcuaaggaaggagaaaguuuaaacuuagcacgaagaaaugccaggcucaugagacguagacuauuucgacguacguggcgguuaaagaaauuagcaagacaauuaaaaagugaagguuuaauugcugauacaaaauuguucaaaccagaauuaccauucucaaagucauuauggcaauugagaguagauggguuagaccgaagauuaaacgaugaagaaugggcuagaguuaucuaccauuuaugcaaacauagaggauuucauuggauaucgagagccgaagcaaaacaagcagaaggagauuccaaaucagaaggcggaaaaguuaaacaaggccuagcgggcaccgcuaaauugauggacgaaaaaggauauagaagcgcagccgaaaugguacucgccgaauuuccucaagcacaacggaauaaacaaggcgaauaccaaaaagccuugagucgagagcuccuagcuaaagaacuugcgcugcuuuuugcacaacaaagagaauaugguaaucuucauaccccgggagcucuagaaacagcuauccuagguaauggugauaagaaaucaggguuauucuggcaacaaaaaccagcauuagcuggcacagaucuccucaaaauguuaggaacauguacauuugagaaaggagaauacagagcccccaaagcaucuuuuacagcagaacgacauguaugguuaacuagguuaaacaauuugcgaauugucacagacgguguaaccagacaacuaacagaacaggagcgacaacuauguuuaccacuaccauauagacaggcuggagaccucacauauaaacaauugggaagcgcgcuugcuaaagcuggucuuuuagaggcaggcgguuuuaaauuuacaggucuagcauauccaaccgaagcacaaaaagcugaaggcaaagcaaaagaucccgaauccgccacuuuaguaaaaauaccagcauggcacgaauuaagacaaacacuuacaaaagguggcuuaaaugacgaaugggaaaaauuagcgggugaugcccuaugcggacaaccagagauuuucgauaaaauugcaugggucuuaagugucuauaaagaugaugacgaaguuagagccgaauuagccaagcuggcucucccuaauccacaagcauuaaccgaagcgcuauuaaauauaagauuugacaaauuucacaguuuaucguuaaaggcuuuaagagcaauagucccacauauggaacaaggauuacgauaugaugaagcaugugugcaagcagguuaucaccacagucaacuauuaaaaguuggagaaggagaacacaaauaucuaccgccauuauacgauggaagagauggcgauggacgcaugauauucgcagaagaugcagauauacccaggaauccugugguccuacguucucuaaaccaagcuagaaaagucguaaacgcaauuauucgacgauacggcaguccaagugcaguucacauagaaauggcaagagauuuaucuagaccauucgaugaacgaaacaaaaucaagaaagaucaagaugaauaucaagcacgaaaucaaagagaucgagaacaauucagcgaacuauucggacacccuccaaaaggucuugaauuugaaaaauggcgauuauacagagaacaaaauggacaaugugcauacucucaaagaccuuuaacagcauccggaaacguagcggaaauuuuccuugaugguagcacagagauagaucaugcauuacccuacucacguucuuucgacgacaguaaaaacaacaaaguucuagugcuaacgagagaaaacagagauaaagggaauagaacaccauacgaauauuuggguggagcugaaaacucagaaucuuggcaaagauuuguauccuucguagagagcaauaaagcauauaggcuagccaaaagaacaagacuacuaagaaaagauuucggagcaaaagaaagcgaagaauuuagagaaagaaauuuaaaugauacacgauaugugugcagauucuucaaaaauuauguagagcagcaccuaaaauuggcagaaggaagugaaacaaaaagaugugucguaguaucaggacaacuaacuaauuuccuucgagccagauggggcuuacuuaaaguacgcucagacagugauagacaccacgccuuagaugcugcagucguagcggcuuguagucauaguaugguucaaagauugaguaacuauucuaggacacgugaauuagaacagguaagagacggauucguagauauagaaaccggggaaauaguaaacccagcaaugcaccaacaguuacgugagcauuuuccagauccauggccuuauuuccgacaugaauuagaagcuaggcuaaaaauagauagucccgaauuacuacgugaagaaauggcuagacuaggaucauauagcgaagaagaacuaaaaguuuuaaaaccacuauuugucagcagggcuccucaaagaaggaaugggggugcagcucauaaagacacaaucuacggacaaccagaaaaauuaaagaaaaauggaagcguaacucaaaaaguagcgcuaacuucauugacccucaaagauauugaucuguuagcagauccacacaggaaugcgaaacuuuacggcgcuauccgugaaagacuagaagcacauggaggaaaaggcgauaaagcauucccagcuacaaacccgcuccgaaaaccugacaaagaaggaaaucccacagggccgauagucagaacaguaacaaaaguaauugauaaacuaagugggauuccaguaagaggagguauagcuaaaaaugauacaaugcuaagaguugacguauucacaaaaggagguaaauuccaucuuguaccaguguauguccaccacagaguaacaggauugccaaauagagcaauaauagcauucaaagaugaagaugaauggacacuuaucgaugauaguuuugacugguguuucagccuauauccaaaugaucugcuacguauaaaacuuaaaaaggaaagucacucagguuacuauucaucaugcaauaggucaaccggagcugugaaccuaugggcucacgauaggaacguuaauguagguaaggauggauucauagaaucaauagguguaaaaauggcgguguccauagaaaaauuacauguggauacuuuagguaacaucuauccagcaccaccagagaaaagaagaggacuagcauga

SEQ ID NO: 5090 - RNA, 3351 nt, Artificial Sequence
  Cas9 variant
augucacaaaaucaaaacccaaacacacaaucacauuuaaacccuacaacacaauccaguacccaaaguaacccacaaccaacaacacaagaaagucuaaaaaucuugggauucgacauaggcguagcgucuauagggugggcauuuguugaagguggagaauuaaaagauugcggcguuaggauuuucacaaaagccgagaauccuaaagauggaagcagccuagcacugccacggcgcgaggcuagaggaguaagacguagauuagcaaggcgaaaaggaagacuaaaugcauuaaaaguacuaaucuguaaagaauuugguuuaaaucgaucugauuaucuagcaacagcaggcgaacuaccgaaagcauacgccacaucuaaagaaacaaaaucuccguaccaacuaagggcagaaucccuagaaagaaaauuaagcgcugacgaauuugcuagaguaauauuacauaucgccaaacauagagguuauggaaacaaacaugcuaaagagucaagcgaugaugacucaggaaaaguaaagaaagcaauuucagaaaaucaaaaagucauguccgaaaaagguuacaccacagcgggccaauauuuauauggugaguucuaccaaaaagcuagaaacuucagugaagccgaaccaaaaagcccgaaaaacgcuaggggaacccaagaguucaaaaauguacgaaacaaaagugaaaacuacgccagauguuuagcucaaagugaauugcaaaaagaacuagaaauaauauucgcaaaacaacgcgaauuuggauuucaauuuagugacaagaaacacaaaacuauaaacgcaaacggaaaauugaaagaacuagacuucgcagaugcaguuuuagaaauagcauuuuuacaaagaccgcucaaaucauuugccgauaaagucggaaaaugcacuuucuaugaagacaaaccccgagcaccuaaagacagucuaucggcuauagaauuugucgcacuaaccagaauuauaaauacauuagcuaacauaacuaaacgaaguggagaaguauauagugcagauaaagugagagaaauacuuagcauagugcucgauaaaggugaaauuacauacaaaaaucucaggaaaguaauagcccuagaugaaagauuacaauuccccaaagacagcaaauuagauuaugcaaaggaagaugccgaaaaagcuaaagccauagaguucucaaaauuaaaagccuucagaaaagcccucggagggucguucgaaggauuuauuagggcagaauuagacagcauagcaacagauaucgcauuaauuaaauccaaagacgaauuaaaagcuaaauuagcaaauuaucaaucguuaaaugaugaacaaagggaaaagcuaagcgaacuuagcuuugauaaauuuauagaccugaguuuuaaagccuuagaagcaauacuccccuuaaugaggggugauaaggaugauaaaauauacagauaugacgaagcauggagagaagcuggauuaguugaaguggccaagaaaacccaaaaaggggauucauugccaccgcuaauagaauacgaaaaagacuuggcaaauccaguaguagcaagagcacuagcagaauacagaaaaguacuuaaugccuuacuaaagaaacauggaaaaguucacaaaauucaucuugaguucaccaggcaggcaggaguaucuucuaaagaaagaggagaaauaaucgcggaacaaaacaaacgauuaaaagcaaaugaagaagcaagaaaaagaugcgaagaauacggacucaucccaucagguaaaaacauacuaaaacuaaaacuauggcaagaacaaggcgaauuuugcguauacagcgguaagaaaauaacccaaagugaccucagagaugaaucaacauuacaaauagaccacauauacccauacaguaggaguuaugaugauucgcaaaacaacaaagugcuaguauucacugaugcaaaucaaaacaaacucaaucaaacaccuuacgaggcuuuugguaaagauauaucaaaauggaaccaaaucuuagggagaauagaaaaauuaccaaaagcaaagaaaaauagaaucacaaauaaaaauuuugcaaacaaagaagcgggcuuuauugccagaaauauuguagauacaaguuacauugcuaggcuuagcgcaaguuauaccgacgcauuuauugaguuuugcccccucgcagaaaaugaagacacuacccuaggaagaggcgaaaaagguuccaagaaacauaucagcguggucaaugguucauuaacagcgaccaugagacacuacuggggccuaaacacauuauuggacggagaaaauagugaaucaaaagaucgaaguaaucacuuacaccacgcucuagacgcuauuaucauagcauacgugaacgauucaguaaucaaagccuuuagcgauuucaagaaaacacaggaacaaaauaaagcaaggcucauagcaaaagaaauugaaagugcugaauauaaaaucucacgacgauucuuuucaccaaguggguucgaaaacaacgaggcauuuagacaagcaauaaaaagaaaaauucuaggacaaagucuagagucacgagagaacgacaugacaauuaacucggaggcauuaggcgagaaaguaggaggaauauuuguuucaaaaccaccaagaaaacgugcuagaggcgcucuacacaaagagacauuuaguucaauagacgacaaagaucuacuuaaaacauauggaggaaaagagggcgugaaccgcgcuauaaaauuaggaaaaguaagacaaauagggucgaaaauagcugacaacggaacaaugguuagaguagauauuuucagacacaaagucucgggcaaauucuacggaguaccaaucuacacaauggauuuugcacuuggcauucuaccaaacaaagcaguaguaggaggaaaagauaaaucagguguaaucaaagacuggcucccuauggacucaaacuacgaauuuugcuucucauuguuuaaagacgaucuuauccucguccaaaagaaagaaauguccaaagcagaacuauguuauuucgcugguuucgauacaaguggaggacaaauuaaaguagaaaaacaugauaaccauuuugcuacacuaacugauaaccaaaggcuacuauucaauauagcaacaccaaaagaaguugcaggaaaaaguaucggaauacaaaacuuaaaaguauuugaaaaauggcaagucucaccacuaggcgaaguuuccaaagcugaauuuaaagaaagagaaccuaucgcacuaaaaaguaccccaaaaagauuuuuacaaggauga

SEQ ID NO: 5091 - RNA, 3354 nt, Artificial Sequence
  Cas9 variant
augaaacacauauuaggacuugauuuaggaagcaacucaauuggaugggcauucguacaacaagauuuugaaaauaaacaagguaaaauaauagcaacuggaucacguauaauaccaauggaucaagguauucuaggugacuucgaacgaggcaauacaguaagccaaacagccgaacgaaccacauauagaaguaugaggcgacuuagagaaagacaccucuuacgccgagaaagacuacauagaguacuucaccuauuaggcuuucucccaccacacuaugacgcccaaaucgauuucacaaaaagauacggaaaauuuauagauaaugccgaaccaaaaaucgcauauaauaauggaaauuucauauuuaugaauuccuuuaacgaaaugguagaagacuuuaaaaaacaccagccgcagcuauuuuauaaaaaaucaaacggcgaagaaucaagaauaccuuacgacuggacuauauauuauuuaagaaaaaaagcacuaagucaaaaaauaacacaacaagaauuagcauggcuaauacuccacuuuaaccaaaaacgcggauauuaucaacuacgaggagaggaagaaacagaaaacccgaauaaagaaguagcuuuucauagucuuaaaguaguagaugucgaagccgaagcaccaaauaaaaaaggagaaauaugguauacaauaagauuagaaaacgguuggaucuauagacggacaagcaaaaauccauuagaugauuggaagggaaaaacaagagauuucauaguaacaacagaccucaacgaugaugguacaauaaaauuagacaaagaaggaaaagaaaaaagaagcuucagggcaccagaugaaaacgacuggaaccuacuaaaaaaaaaaaccgaacaugacaucgacuucucaggcaaaccagucggaacauacauuuaugaucaccuuuuacagaacccgaaucagaaaaucaaaggaaaauuaguccgaacaauugaaagaaaauacuauaaagaugaacuuaaagcaauacuugccaaacaaauagcgcuccaaccagaauuauucacagaaacccucuuagcugacugcauucgagaacuauacagaaaaaacgagacccaacaacaaaauuuacucagcaaagacuuuuugcaucuauuuguagaagauaucauauuuuaccaacguccacuuugcagcaaaaagucaacuauugcaaacuguacacuggaaaaacggaguuacauagauaaagaaaccaacgaaagaaaagacgcaccaauaaaaguaugcgcuaaaucaaauccuuacuaccaagaauuccguguacuucaaugguuacaaaaucugagaauauaugaaaucgaaacagacagagaaguaacagcagaguuuaucgagacaccucaagacuacgaagcccuauucaacuucuuaaugucucaaaaagaaaucgauaaugaaggauuauuaaaguauuuucuauucgcaaagaacccacaaauuaaagauaaagccgcaaaaagugaauuaaaaaaauggcuuacaaccuauagauggaacuauguguacgaugcagcugauaacuccucgaaaaaauaccccaugaacgaaacuggauaugaacuucaacgauacuuacaaaaaguagaaggccuccccgcaaacuucuuaacuuuugacaucacuuaucaacucuggcaucuacuauacucuguaaaagacaaaguagaauucgaaaaagcucuuaaaaaguucgcuaaaaaaaaacaauuggauaaaacaucuuucgucgacagcuuuaaaaauuucaaaccuuaucccaaugaauacggaucuuucucagaaaaggcgauaaaaaaacucuugccucucaugcgauuuggaaaucacugggacuuuaaucgaauagauguaaguacucaaaagagaauagacgaccuaauuaacggcguagcaaacgaagauauucgaacgaucauacgcgaaaaagccgaaaaauaccaauuaaauucugaaaccuguuuccaagacuuaccacucuggcuagcacaauacguagucuacaaccgacaugccgaagcuaccgacauagaaaaauggacaucugucucagaccuugaagcauaccuggaagauuucaaacaacauagucuuagaaacccgauaguugaacaaguuguaacagaaacacuacgggucguucgugauauauggcaacaguauucgggaggucaagcaaauuuuuuugacgaaauacacaucgaacuuggacgagagcugaagaagacagcagaagaacggaaacaauugucagacaagaaucaagaaaacgaaaacacaaaccuaaggauaaaaaaguugcuggccgaacuaaaagaagaugcaucuauccaaaacguaaggccauacucauuggugcaacaggaacuauugaaaauauacgaagaaggaguauuuucauccacggaugaaauagaagaagacauucagaaaauaagaaagaaagucgaaccuacaccacccgaaauacaacgauauaaauuaugguuagaacaaaaauauaaaaguccauauacaggagaaguaauaagccuaacuaaacuauucacugaagaauacgaaauugaacacauaauaccacagucacgauacuaugaugacagucucuccaacaaaguaauaugugaaagcgcugucaauaaauuaaaaacgaaccagcuaggauuagaauuuauacaaaaccaccacggagaaaaaguacgaauaacagcuaacaaagaggucaccauauucacagaagagcaauacaaagaauucguaaaaaagcacuaugcgaacaauucugcuaaacaacaaaaacuacuccuaaacgaaauuccagaaaagaugguugcgagacaacuaaaugacacacgauacaucuccaaaugcauuuccgaaaucuuaucuaaaaucguacguagcgaugaaaaagaugaaggaguuaacaguaagaacaucauaccuuguacaggaaaaauuacuacugcacuuaagcaagauuggggacuaaaugauguauggaacgaacuaauacuaccgagguuugaacgaaugaaucaacuuacacaaacacaauuguuuacaaguuacaaugacaggcuucaaaaaaaccuccccacuguaccaauugaauacagccaaggauuucaaaaaaaaagaauugaucacagacaucaugccauggacgcauuagucaucgcaugcgcaacaagagaacacauaaacuacaugaauaaucaacaugcccucgacaaaaguaaagacaaaaaagaaaagcaacaaagucgaaucgaccuccauccuuuauga

SEQ ID NO: 5092 - RNA, 3354 nt, Artificial Sequence
  Cas9 variant
augcaaacuaaaaauuuguuguacacauuaggguuagauauagguauagcaagugucgguugguguguauuaggagaaaauaggauuaucgacuugggaguaagauguuuugacaaagccgaaacaccagacagaggagaaucauuaaauaaaguuagaagagacgcaaggcuaaugcgucgaagacuaaggagacgagccuggagacuaacaaaauuagccagacuacuaaaacacgcaggccuuauugauuccacucgaauaguaagagaucggcaugauggggccgucucuccauggcaauuaagaguugaaggacuugaccgaaaauuagcaccagaagaaugggcaagagucaucuaccauauagucaaacauagaggauuucacuggauuucaagagcugaggaaagaaaggcagagucagauaaaggagaagggggaaaaguaaaacaaggacuaagcgcaacuaaacaacucaugguagagaaaaauuacagguccgcagcugaaaugguacuaacagaguucccaggagcacaaagaaauaaaagaggggaauauacuaaagcucucaguagaauacuacuugcagcugaacuuaccacauuguucgaaagacaacaagagcuuggcaacccgcaugcaggaccagacuuacaaaccaaaauauuaggcaauggagauagaaaaaguggucuuuuauggaugcaaaagcccccgcucagcggcucugcauugcuuaaaaugcuuggaaaguguacuuucgaacgagaagaauauagagcacccaaagcaucuuuuacggcugaaagacacguuuggcuaacaaaauuaaauaauuuacgaguauuaguagacggcguaacgagaccauuaucagauccugagaggaggcucgcguuaaguuuaccauaucagcaagcaagugacuuuacauauaaacaacuaagagcagcucuaugcaaaaaugggcuacucccagauucuuuucaauuuucgggacuggcuuacccaacaggugcccaacagccagauggcaaagcuaaaaauccagagaacgaccgauuagucaaacuaccggcauggcaggaguuccgaaaaacgcuaagagacgcaggacuagaaacagaaugggaaucaauagcgggaauggcagccggugggcaaccagauuuauuagaucaaauaggcuggguacuuuccguuuuuaaagauggagacgaaguacuacgugaacuaagaaaaauaccacuaccaggaggagagaaaaugguacaggcccugaguggagugucauucgauacuuuucacaaucucagucugaaagcauuacgaaagauuguuccacauauggaagcaggauuaagguaugaugaagcaugucucgcagccggauaucaccacagcgaucuaagaaaagauaccgaugaaagaaguuuauacuuaccaccccuauauucuggacguacaacagauggaaggaugguauucagagaugauauagauguaccgagaaauccgguuguauugcgcgcgauaaaucaagcaaggacuguuguuaauaguguaguacguagauaugggucuccaaguuccaugcauaucgaaauggcucgagacuuaagucguccaugggacgaacgaaacaaaguaaaaagagcacaggaagaauauagagacagaaaugaaaaacuuaaaauagacuucgcagcagaguacgguauagaaccaaaaagcagagaauuugaaaaauucuuacuauaccgugaacaaggaggaaaaugugcauacagucugaaaccacucgaucuugacagagucuuaagagaucucggauaugcagaaguggaucaugcacugccauacagcagaaguuuugaugauaguaaaaauaauaaagucuuaguucuggcggaagaaaauagaaacaaaggaaauaggacaccauaugaauauuuggauggaaccucagaaagcccaagauggagagaauuuaaagcauuuguugaaacaaauaaagcauaccgacuagcaaaaagagcucguuuauuacgaaaagauuuuucaggaaaaggaagcgaagaauuucgugaucgaaaccuuaaugacaccagauauauaucaagguucuuuaaaaacuauguagaaagauuucuuaaguuagcagaggaauccgaagaaagaaccuguguagugcuaagcggacaauuaacagccuuucuaagagcgagauggggauuagcaaaaguaagaggcgacucagauagacaucaugccuuggaugcggcaguuauugcagcuuguucaagaagcauggugaaacgacuaucugacuaugcccgacgucaugaauuggaaaaggucaggacaggauucguugacuucgaaacaggugaaauaguggaugcggggaaauaccgacaaauagaaagagacuuccccagccccuggccauacuuucgggaugaauuauuaacaagauugaauacagacgacccagccgaacuuagagaaagaaugcaaucuuugggauccuauccaccagaagcacuugaaacacuuagaccaauguuugugucaagagcaccucaacgacgaaacggaggagcagcacacaaagauaccauauauagacaaacagaacgauuaaagaaaguuggcucgguaacacaaaaaguuccauuagcagcacuaaaucuuagagacuuagagaaucucguagacccacauaggaaugaaaaacuuuacgcagcaauacgagcacgacuugaagcccauggaggaaaaggagagaaggcuuuucccccaaauaauccucucagaaaaccugauagagacggaaauccuacgggaccaauaguuagaacuguaacguuaguaauagacaaaaugucaggcauuccagucagagguggaguagcgaaaaaugacacuauguuaagaguggauaucuuucgaaguaagaaagacggcaaauuucaccuaguaccauuguauguacaccaugcaguugcaaaacaauuaccuacaagagcaguaaucgcauauaaagaugaaggagaauggacuccgauaaauaaucaugauuuugauuuucuguuugcauuauacccuaaugauuuaguacgaauaacccuaaagaaagaaagacacuuuggauacuaugcagggugcaauagagcaacaggagcaguuagcauaugggcacaugacagaaaccaacgaauuggaaaagacggauuuauagauggaaucggaguuaaaacagcauuaaguguugaaaaauuucauguggacacacuaggaaacguauacccagcaccuccugaaacucgaagaggccucgcuuga

SEQ ID NO: 5093 - RNA, 3357 nt, Artificial Sequence
  Cas9 variant
augggaacgagauauucauuugauauaggaacaaauucaaucggaugggccguguggagaacaggaagagauccaaaagguauauucggagagaaagacgcaccucuugaauuauugggggcagggguuaggcucuuuaaagacgggagaaacccuaaagacggucaaucacuagcgacuaugcgaaggauaccacggcaagcucgaaaacgaagagauagauuuguauuaagacgugaagcucuaguagcugcauuaauugaagcaggacugaugccugcuucugaaaaagaacgaaaagcauuagcugauuuagacccguaccaacugagagccgcaggauuggacaaagcauuagccccacaugaacucgguagagcaauuuuccaccuacaucagaggagaggauucaaaagcaacagaaaaacagauaggaaaagugaugauagagauaaagggaaaauagcuacggcuagcgcugcacuagcuaaaaaguuugaagaugaaaaugccagaacauuuggugaauuucuauggagacgucauagagacccagauaugaaaagacaagcaguauuaaaagcacaugauccugcuaaaggcaaaccagacuuaagggcggcuaaauuaagacaaccaacgagaauuagauuagaagggcaaggagccaccgcacuauacgaauuuuauccaacuagagaaaugcuaugucacgaguucgaugcacuuugggaagcacaagcccgacaccacccaauguuacuaacaagggaagcaggagauaaaauuagauccauacuuuuccgacaaagagaacuaaaaccaccgcuaauaggcuuauguacauucgaauaugcggcuggagaaaaagaaucaagguuaccuaaggccuuaccgucaguacaagcgagagaaauauaugaaaggcuaggucauauaagauuaucaacaggaucggggacagacagaccauuaaaaucaucagaacgagacgauuuggcuacugcuuuguuacauuguggguuaacaaaaauaaaaguuaguaaaacgaaaggauuagcguuuaaaaccgaauuuagaaaagcgcuaaggcuuggaggugaagugagaaucaacuuugaagaaaugggagaagaaggauuaguagacuuaagaacaaacagauuauuaguccaagacgaucauuacgguccaagauggagggcccuaagcuggaguggaaaagaugcauucgucaagaaacuauuggaagcaacagaugacgacaaauuaguggcacguuuaaugacagaagauggauuaucagcuguccaagcgagaaaugcagcgucaauacccuuaccagauggauacaguaggcuugguccgacagcuaaugcagcaauauuacaagcacugaucgacagcagggaugagaauggauucguaguaacauacgacaaagcagugcgacgcgcuggugaaaggcucggaaaagacuggcaucauagugaugaacgagauggugaaauauuagacgcacuuccauauuacggaaaaguacuucaacgacauauacuuccugguaugauggauccggcugauagaaaagacgaagcaaaauuuuaugguaggaucaugaauccuagcguccauauuggguuaaaucaacuuagacgucuagugaacgcccuuauagaaagguucgggcccccugaucagauaguaguagaacuggcaagggauuuaaaaaugucugcaagagaaaaagaacaagaacaaagacgaaauagagauaacagagaggcaaaugagaaaagaacgaagaaauuaguagaauuggggcaagauaauaacggagaaaacagagcucggcugaaacucuaugaugaacaacaaagggcagggaacggagucgcucauugcccauuuacguuagaccccauugggauaacucaguuguuuucuccugaaauagaaauagaacaugucuuaccgagaaguagaacccuagaugauagugcagcgaauaaaguacuauguuuuagaacaauuaauagaauuaagagaggaaaaacgccaugggaagcguuucacgcagauccuaaauggcccgauauugcagcaaaugcugaaaaacugcccccaaauaaaagauggagauuuagagaagacgcuauggauguguuugaggcaagaacaagugguaaaauggauaagacaacacuggagcaaaugggauuaacaacagguuuucaagcaagacauuuaaacgaaacgaaacacauguccagauuggccaaggccuauuuaggaaaaauaugcgauccagacgcaguuuaugucacaccaggagcauuaacaaguuuacugcgaggcaaaugggguuuaaacucaauacuaucagaugauaauuuaaaagacaggacugaucacagacaucaugcaauagacgcaauuacgauaggagcgaugacaagaucauuauugcuugaauuaaacacauuagcugguaaagcagaacagagcgauuacgaugauguagucgggaagguaccauggccauucgacaacuuccgagacgcaguucgguccguuguagauagaguuguaguaucaaauaaaccagaacacggaaaacagggagcuuuacaugaggauacagcguaugggauagucggggacgaagcagaggcagaagagauaggaaaucucguuagaagaaaauugcuuguugaccuaacaccaggugaaguagaccggauucgagaugcgggacuaaggaaagcaaugcaagcagcaguugcacccagcagagaugcuagaggaaaagucucugaugcuaagggauucgcagcagcauuagacacuuuugcaaaagcacaagguaugagacgaaucagaguuggaaaagaagacaugucagcaguaacgauccaugauagacaaacagauaaagcauauaaagcaguagcaccaggcgaaaaucaccacguagaugucgugcagaugagagacggugcauggaaagguuucgcuguaacgguauuugaagcaaaccagaaggauuuuagaccacaaugggaaagagagaaguuaggagguaaauuaguaaugagauuacauaaaggugaugcaguagaacuagaaucaucuggaguuagacugguaaaauuuguacagcagauauggaugaaaucaaauuuaguacucuuaacagaacauaaugaaggaggggaccuacaaaaacgacaccaggaugcagaugacccguuccgaugggauuucgcaaauauuggaaaauuaaaagaaagaggaugugucgcuguuaaaguggaugaauuagguaggguaacaaaaagaauuucaaauacauga

SEQ ID NO: 5094 - RNA, 3360 nt, Artificial Sequence
  Cas9 variant
augggauacagaauaggauuggacguaggaauuacaucaacaggcuacgcgguauuaaaaacugauaaaaacggccuaccauacaaaauacucacgcuugauucaguaauauacccgcgagcagaaaacccacagacaggcgcuucacuagcagaaccaagaagaauaaaaagaggacuaagaagacgcacaagaagaacaaaauuuagaaaacaaagaacgcaacaauuauucauacacagcggacuacuaucaaaacccgaaauugagcaaauauuagcaacuccacaagccaaauacucgguauaugaacuaagaguagccggucuagauagacgauuaacgaacucggaguuauuuagaguguuauauuucuucauaggccacagaggauucaaaagcaauagaaaagccgaacuaaacccagaaaaugaagcagauaagaaacaaaugggccaacuccuaaauuccauagaagaaauaagaaaagccauagcagaaaaaggauacagaacagucggcgagcuguaucuuaaagauccuaaauacaacgaccauaaacguaauaaagguuauauugacggauauuuaucuacucccaaccgacaaauguuaguugaugaaauaaaacaaaucuuagauaaacaaagggaguuagggaacgaaaaauuaaccgacgaauuuuacgcaacauauuuguuaggagacgaaaauagagcuggaauuuuucaggcacaaagagauuucgacgaagguccgggggcagguccuuacgcaggagaucaaaucaagaaaaugguuggaaaagacauauucgaaccaacagaagauagagcagcgaaagcgacuuauacauuccaauacuucaaccuccuucagaaaaugacaagucugaacuaccaaaacacaacaggagauacuuggcauacacuaaauggccuggauagacaagccaucaucgaugcaguuuucgcgaaagcagaaaaaccgacaaaaacuuacaaaccaacugacuucggagaguuacgaaaauuauuaaaauuaccggaugaugcuagauucaaccuagucaacuauggcagcuuacaaacgcaaaaagaaauagaaaccgucgaaaagaaaacaagauuuguugauuuuaaagcauaucaugaccuaguuaaagucuuaccugaagaaauguggcaaucacggcaacuccuagaucacauaggaacagcacuaacacuuuauucaucagauaaaagaaggagaagauacuuugccgaggaauuaaacuuaccagcugaacugaucgaaaaacuauuaccacuuaauuucaguaaauuuggacaucuauccaucaaaagcaugcaaaauauuauuccauaucuagaaaugggacaaguguauucagaagcuaccacuaacacuggauacgacuuucggaagaaacaaauauccaaagauacaaucagagaagaaaucacaaauccagucguaaggagagcggucacuaaaacaauaaaaauaguagaacaaauaauaagaagauacggaaaaccugacgguauuaacauagaacuagcaagagaacuaggaagaaauuuuaaagaacguggugauauccagaaaaggcaagacaaaaaucgacaaacuaaugauaaaauagcagccgaauuaacagaacuaggaauaccagucaacggccaaaauauaauacgauacaagcugcacaaagaacaaaacggagucgacccauacacgggagaucaaauacccuuugaacgagcauucucagaaggcuacgaaguagaccauauaauaccauacucaaucucaugggacgauagcuauacaaacaaaguauugaccagugcaaaauguaauagagagaaaggcaacagaauaccuaugguauaucuugccaauaacgaacaacgauuaaaugcacuaacaaauauagcagacaacauaauucgcaauucacgaaaaagacaaaagcuacuaaaacaaaaacuaagugaugaagaauuaaaagauuggaaacaaagaaacauaaacgauacgagauuuauaacgcgaguacuauacaacuacuuuagacaagcaauagaguucaacccagaauuagaaaagaaacagagaguucucccucugaacggugaaguaacaucaaaaauuagaucucgauggggauuccuuaaaguacgagaggacggagacuuacaccaugccaucgacgcaaccguaauagccgcuauaacaccuaaauuuauacaacaaguuaccaaauauagucaacaucaagaaguuaaaaacaaccaagcucuauggcacgaugcagaaauuaaagacgcugaauacgcugcagaggcccaaagaauggaugcagaucuuuucaauaaaauauuuaauggauucccuuuaccuuggccagaauuuuuagaugaacuauuagcuagaauaagcgacaacccugucgaaaugaugaaauccagauccuggaacacuuauaccccaauugaaauugcaaaauuaaaaccaguauuuguaguccgacucgcaaaccauaaaaucagcggcccagcacaucuagacacaauacgaagugcaaaauuauuugaugagaaaggcauaguacucucaagaguuucaauuaccaaacugaaaauaaacaagaaaggccaaguagcaacuggagacggcaucuacgauccagaaaacagcaacaauggugacaaaguaguauacuccgcaauacgucaagcguuagaagcgcauaacggaagcggcgaacuagccuuuccagauggauaucuggaauacguagaucaugggaccaaaaagcuagucagaaaagucagaguagcuaagaaaguaucccuaccaguaagauugaaaaacaaagcagcagcagacaauggaucaaugguacgcauagacguauucaacacaggcaagaaauucgucuuuguaccuauauauaucaaagauacaguagagcaaguucuacccaauaaagcaauagcuagggggaaaucacuaugguaucaaauuacagaaucugaucaauucugcuucucuuuauaucccggagauaugguacacaucgaaaguaaaacuggcauaaaaccaaaauacucaaacaaagagaacaauacuucaguagucccaaucaaaaacuucuauggauacuuugacggagcagacauagcaacagccaguauucuuguaagagcacaugacucaucauacaccgcacguaguauaggaauagcaggucuuuuaaaauuugaaaaauaccaaguagauuauuucgguagauaccacaaaguacacgaaaagaaaagacaacuauuuguuaaaagggaugaauga

SEQ ID NO: 5095 - RNA, 3360 nt, Artificial Sequence
  Cas9 variant
augaaugacaagaaaaaucuaggaccguugacauucggauuugacauaggaauagcuaguguagguugggcagugcuaucuccuacaagaaucgucgauuugggaguuaggugcuuugauaaagcugaaacagcaaaagaaggagaaagucuaaaucucgcucgaagaagugcuagacuaaugagaagacgguuacgcagacgagcuuggagauuaauaaaacucgcaagacuauuaaaacaugaagggcuaauugcagacacaaaaacuuucauacaaccaucagcuucacaugcuucaccauggcaacuuaggaaagacggauuagacagagcacuuucuccagaagaaugggccagagugcuauaccaucuaugcaaacauagaggcuuccacuggguuagcagggcagaagcaaggaaagcagacggagacacuaaaggagaaggaggaaaaguaaaacaagggcuagcaaguaccacaaaauuaaugaacgauaaaucguaucgaacagcagcagaaaugguucucgcugaauuuccaucagcccagagaaacaaacggggagaguauacuaaagcauuaagcagagaauuauuagacaaugaguuaaaacaacuuuuugaaagacaaagggaguacggcaauccacaugcggauacaaacuuagaggcaaaaauaagaggauccggagaccauaaaucaggauuauucugggaacaaaaacccgcuuuaucaggaaacgauuuacuuaaaaugcuugguaaauguacauuugaaaaacaggaauauagagcacccaaagcaucauuuacagcagaaagacauguguggcuaacacgguuaaauaacuugcgaauuauaguugaugggagaaccagaccguuagcggaugccgaaagaacuauggcgcuaagucuaccauaugaacaaguaggcgacuuuacguauaagcaacucagggcugcauuagucaaggcaggauuaaugccugauaguuucaaauuugcaucccuagcauauccaagcgaauuucagaaggcagaaggaaaagcaaaagauccugaaucagcugccuuaacuaaacuagcagcguggcaggaacuaagagcuacgcuuaagaaagcagauuuagaaucugaauggcaacaaauaaguugugccgcucuugaaggucaaccugaaacuuuagaugaaauugcaggaguauugucaguuuucaaagaugaugaugaaguuuugaaugaauugcaaaaacucggacucccaggaggagcaaaaacugaaaaugcuuuacucgacaucagauuugacaaauuucaugcauuaucauuaaaggcuuugagaaaaaucguacccuauauggaaagaggucuacgauaugaugaggcuugugaaagagcagaauaucaucauagccaacuacauaaaguaggugaggguaaucgaaaauacuuaccacccuuauacaaaucccgugacaaagauggaagaauggucuuuaaugacgaacucggcgauauaccccggaauccuguaguacugcgauccuuaaaucaagcaagaaaaguauuaaacgcucuaaucgcaagauacggaucaccgaguuccguccauauagaaauggcaagagaacuaucaaaaccauuugaugagaggaugaaaguuggcaaagaacaagaggcuuauagagaaagaaacgaaaaagauaaacaaacuuuuguagcagaguucgguauagucggcgcagccaaagggggugaauuugaaaaauggaaacuguaucgugaacaacaaggaaaaugugcauauaguauacaaggaauagaccuuaauagauuguuggaaccaggauacguugaaauagaccaugcuuuaccuuacucacgaaguuucgaugauaguaaauccaauaaaguauuaguuuuggcagcagaaaacagaaauaaaggcaauaggacaccuuacgaauacuuagauggagaacauaauucagaacgauggaggcaauuugucggcuuugucgagucaaauaaacuauauagacaagcaaagagaaguagauuacuaagaaaagauuuuggcaaagaacaagcagaugaauuuagagaaagaaaucuuaacgauacaagauauguuugcagguuuuucaagaaucaaguugaacaauuuuugaaacuugcggaaggaucagaaucaaaaagauguguaguacuuucuggacaacuuaccgcauucuuaagggcaagauggggacuaauuaaagugagggaugaaagugaccgacaucacgcauuagaugcagucguuguagcagcaugcacacaugguaugguaaaaagaaugagcgauuacgcaagaagaaaagagcuugaucaaguagccgagggcuuuguagacguagaaacaggugaaauaauuaaugcagcaauguuucaacaacuccacgagcauuucccugacccguggccccacuuccgagacgaaguccaaaugagauuaaaaaucgacgacccagcacaauuaagaucugauuugcuacgucuaggaaauuacgcugaggaggauguacaugcagucaggccauuauuuguuucacgagccccgcaacguagaaauagcggugcugcccauaaggaaaccauauauggccaaccugaaagauuaaaagcacaagggggagugacggaaaaaguggcauuaacagcacuaacaaugaaagaucuugaucguuuaauagauccccaucggaaugaaaaauuauacgcagccauacgaaaacggcuugaagaguucggaggaaaagcagauaaggcauucgcagcaucaaauccacuacacaaaccggauaaagaaggaaauccuacuggaccgaucguaagaacuguaacacuagaaauagacaaacuuucaggaguuccaguaagagggggaauagcuaaaaaugauaccaugcuaagaguagauguuuucaccaaagcaggaaaauuucauuuaguaccaguauacguacaucauaagguuacaggacuaccuaaccgagcaauuguagcaagcaaagaugaagacgaauggacggcuauagaugacucauuugaauuuuuauucucacuauacccaaaugacuuaguaacgaucacccagaaaggaaaagcaccaguacguggcuauuaugcuagcugccauagaggaacuggugcuuuuucacuuugggcucacgauagagcaaguagugucgggaagggaggacaaauagaaggaauaggaauaaaaacagcauuagcuguccaaaaauauaauguagacguacuagguacaaccuaugcagcacccuuagaacaacgaagaggauuagccuga

SEQ ID NO: 5096 - RNA, 3363 nt, Artificial Sequence
  Cas9 variant
augaggaaaguaacaauaggauucgacauagggguaucuagcgugggaugguccguaguugauaugaacaacggagcaaucguugaaacuggugugagacuauuuucagcgucaucagccgaaaauaacguagaaagaagaaauaaucgucaaaccagaagacuaaaucgacguaggaaaaacagauuaaaagauguuaaauaccuauuagaaacgaaucauuucacauuugaucaagaacaagguacaaauccuuacgaauuaaggguagccggacuacacagaaaacuaacacgaucagaacuagcaagagcacuauaccaccuaguaaaaagaagagguauuagcuaugaccucacagacauagaagaagaagaaauagugacaaccagcgcauacaaaacagcauugggcaaaaaucaaucacaauuggccgagaaaacaccaggggaaauucaauuugccagacucgaaaauuauggaaaaguacgcggaucuauagaaaucaacgaacaagacauacuacuaaacauauuuccaacaagcgcauacuuaaacgaagcaaaaagaauauuagcuacacaaagaaaauucuaccccgaaauaacagaagcauucauagaaaaauacugcacaauccucacgagaaaaagagaauacuauguagguccaggaacggagaaaaacagaaccgacuacgguaucuaccgaacuaauggagaaacccuugauaaucuauuugaaauacuaauagggaaagacaaauucuacccaaaugaagaaagagcugcaggaaauagcuauacagcacaacuauucaacuucgucaaugaccuaaacaaucugaaaauacagacgauagaagaccaaaaacucacacccaaacaaaaagaagaaaucauagaacaagugaaaaccgccgagaagaaaguuucacucauacaauuaauaaguaaaauaacaaaaacaccaaaagaucaaauaacaggauacaggacagauaaaaauggaaaaccugaccuacacucaauggcaguauuuagaaaaguuagaaaacaauuuuuaacaauggaaauagacaucuuacacuggcccgaugaacuucuuaacgauuuaggaaggcuccuaacauuaaacacagaaaaaggagaaaucagaaaacaacuaacgaaagacuucaugaaacgcuacccuauacuaaacgaacagcuugucgaucaaauaauugaaaaccggcacaucuuugccguuagcgguaaucauaaauggcaccgauucucacuuaggacaaugaacgaacuacuaccugaaaugcuagccacaaguaaagaacaaaugacacugcuaucugagagagggaugauaaaacaacauaaacgugacuaccuaaaaaugaaugaauuagacgcccgacugauauccgaagaaauuuauaauccuguuguaggaaaaucaguacgagaagcaaucaaauuauucaacgaauuaaugaagaaauaccaagaaguaagguaugucguacuggaaaugcccagagacgacaacgaagaaaaagccaagaaagaacuccagaaauaucaaaaagaaaaugaaaacgagaaagaaauagcacuaucagaauuucaaagaaaaggauucuuuagcgaugcacaauuagaacgagcauuaauaaaagauagaaaacuaaaaacuaaaauuagauuuuggcaucaacaagaagguaaaugccuuuauucuggacaaaucauaacaccggucgagcuauuaaccaacaguuucucauuugacaucgaccauauuauaccacaaagcguuaguuucgaugacucauuaaacaacaaaguauuaugcacaaaagaaaugaacgaucaaaaaggaaaacaaacacccuacggcuucuuacuaaauggaaacggucaaggauucgaucgcuuuaaagcaaugguaaacgccaaccgucuaaugucaaaagggaaaaagaaaaacuuauuauucauggaagaucuaaacaauauagaaacacgaaaaagauucauugcaaggaaucucguagacacacgauacgcaucuagaguaguacuaaacgaaauacaacaauacuuaagagccaaaaacaaagauacccagguugcaguaguaagaggaaaauucacggcaacccuucguaaacauuggaauauaaacaaaaguagagaaacucaccaccaucacgcccuagaugcuucuauaauagcaauuacuccacuauuaucgguauggaaaaagaaacaaacacuaauaccaaaaacuuuaucugaagaaaaacuagaauuugaauaugacgauauaguugaagauacaaucuucgaaaaagcacuuuaccaauuaccuaaagaaaacuucaaagaacaauuaaauaacucacagccaaacauaaaauuuucauaucaagucgacaagaaaaugaacagaaaaguuagcgacgcgacaauauauagcguaaaacaagcaaaauuaucgagcgacaaacaaagcgaagaguacguacuagcaaaaauaaaagauaucuauagcguagaaggauauaaaaccuucgcaaaaauuuaugaaaaggacaaaucaaaauuccuaauggcucaaaacgacccaaaaacauucgaaaaacuugaagaaauaauacaaucauacccaaguacuagagaaauaaucguaggagaaaaagugaaaguagucgacguaucaccauucgaacuguaccgaaaggaauacggauacaucacgaaauaugcaaagaaaaauaacggaccgauaauccgacaacuuaaauauuaugaccacaaaauagguaugcauuuagauauaaccaaccagaaaaauaauggcaaaggcaagaaaguaauauuacaacaacuaaaaucguggaggacagacgucuauuacaaucacgaaaaacaggaauacgaaauaauggguuuaaaauauuccgaucuacguuuuaagaaagaccaauacggcauaccuaaagaaagguaccaagaaguaaaacaaauggagaaaauagcaccacagagugaauuuuguuuuucauuauaccgaaaugauaggauaaaagucuuaaauaaagagacagaugaagaaguugaacuucuauucggagcaagaaacuacacgagugcaggauacgucgaccugaaacccauagacagaguagaauuuggcaagaaagaauggauuccaguauaccaauaugcuacaagugacggaaaaugcaagaagaaauuugcuaagaaaggauacgaaauuuauaaaguaaacacgacuauacuaggagaaaguuacuacaucaagaaagaaagaaugcuaccgaaaaauauauuagauuga

SEQ ID NO: 5097 - RNA, 3363 nt, Artificial Sequence
  Cas9 variant
augucagaccuaguacuaggauuagacauaggaauaggaagcguaggaguugggauacuaaauaaaguaacaggagaaauuauccauaaaaauaguagaauauuucccgcagcacaagccgaaaauaaucuaguuaggagaacuaaccgacaaggacgacgacuuacaagaagaaagaaacauagaagaguucgacucaacagauuauuugaagagauugggcuaauaacggacuuuacaaaaauaaguauuaauuugaaccccuaucaacuaaggguuaagggccuaacagacgaacugaguaaugaagaacuguucaucgcccuuaaaaacaugguaaaacacagaggaauaaguuaccuagaugacgcuucagaugacggaaauucaucagucggagauuacgcacaaaucguaaaagaaaauuccaaacaacuugaaacaaaaacaccaggacaaauacaauuagaaagauaccaaaccuacggacaacuaagaggugauuucaccguagaaaaagaugggaagaaacacagauuaaucaacguguuuccuacaucagcauacagaucagaagcauugagaauccuucaaacucaacaagaauuuaacccacaaauuacggacgaguucauaaacagauaccuagaaauauuaacaggaaaacgcaaauauuaucacggacccgggaaugaaaaaucaagaacugacuacggaagauaccgcacaucgggcgaaacacucgauaacauauucggaaucuugauagguaagugcacauuuuacccagaugaguucagagcagcaaaagccucauacaccgcccaagaauuuaaccugcuaaaugaccuaaauaaccuuaccguaccaacagaaacuaagaaacugaguaaagaacaaaagaaccaaaucauuaacuacgugaaaaacgaaaaagcaaugggaccagcaaaacuauucaaauauauugcaaaauuacucucaugugacguagcggacauaaaaggauauagaaucgacaaaaguggaaaagcagaaauacauacauucgaagcauaccgaaaaaugaaaacacuagaaacacuagacauagaacaaauggauagagaaaccuuagacaaacuagcguacguacuaacuuuaaacacagaacgcgaagguauucaagaagcccuggaacacgaauuugcagauggaucuuuuagccaaaagcaaguagaugaauuaguacaauuucguaaagcaaacucaucaauauucggaaaaggauggcacaauuucucaguaaaacuaaugauggaauuaauuccugaauuauaugaaacuuccgaagaacaaaugaccauauuaacaagacuugguaaacaaaagacaacaucaucaucgaacaaaacaaaauauauagacgaaaaauuacuaacagaagaaauauacaacccagugguagccaaaagcguaagacaagcaauuaaaaucgucaacgccgcuauaaaagaauacggagacuuugauaacauagucauugaaauggccagagaaacaaacgaagacgaugaaaagaaagcaauucagaaaauccaaaaagcaaacaaagaugaaaaagacgccgcaauguuaaaagcagcaaaccaauauaacgggaaagcagaacucccgcacucagucuuccacggacacaaacaacuugcuaccaaaauacgacucuggcaccaacaaggcgaaagaugcuuauacacaggaaaaaccauaaguauccaugacuugauaaacaaucccaaccaauucgaaguugaccauauucuaccacuaaguauuacuuuugacgacucucuagccaauaaagugcuaguuuacgcaacagcaaaccaagaaaaaggacaaagaacaccauaccaagcacuagauucaauggaugaugcuuggucauuucgagaacuaaaagcauuugucagagaaagcaaaacacugucaaauaaaaagaaagaauacuuacugacagaagaagauauaagcaaauuugacguccgaaagaaauucauagaaaggaauuuaguagacacaagauacgcaagccgggugguucuaaacgcacuacaagaacacuuuagagcccacaaaauagacacgaaagucuccgugguaagggggcaauucacuucacaacuaagaagacacuggggaauagagaaaacacgagauacauaucaccaucacgcaguagaugcccugauuauugcggccagcucccaacucaacuuauggaagaaacagaaaaacacauuaguaucuuauuccgaagaccaauugcucgacauugaaaccggagaauugauaucagacgacgaauacaaagaauccguuuucaaagcucccuaccaacacuuugucgacaccuuaaaauccaaagaguucgaagauaguauacuauucagcuaucaaguagauagcaaauucaacagaaaaauaagcgacgcgacuauauacgcgacacgccaagcaaaagugggaaaagauaaagcagaugaaacauauguacucggcaaaauaaaagauauuuauacccaagaugguuaugacgccuucaugaaaauuuacaagaaagauaaaucaaaauuccuuauguauaggcacgacccacaaacauuugaaaaaguuauagaaccaauauuggaaaacuauccaaauaaacaaaugaacgaaaaaggaaaagaaguuccaugcaacccguuccuaaaauacaaagaagaacauggauacauaagaaaauacucuaagaaaggaaacggcccagaaauaaaaucacuaaaauauuacgauagcaaacucggaaaccauauagauaucacgccaaaagauagcaauaauaaagugguacuucaaagccuaaaaccuuggaggacagacguauacuuuaacaaaaacacagguaaauaugaaaucuuaggcuuaaaauacagcgacaugcaauucgaaaaaggcacaggaaaauauucuauauccaaagaacaauacgaaaauauaaaaguacgagaaggcguagacgaaaacucagaguucaaauuuacccuauauaaaaacgacuuacuguuacuuaaagacucagaaaacggagaacaaauuuuauuacguuucacaucaagaaacgacacuuccaaacauuauguagaacuaaaaccauacaacagacaaaaauucgaagguuccgaauauuuaauaaaaagccucgguacagucguaaaagguggccgaugcauaaaagguuuaggaaaauccaacauuagcauauacaaaguccgcacagacgugcuaggaaaccaacauauaauuaaaaacgaaggcgauaaaccaaaacuagauuucuga

SEQ ID NO: 5098 - RNA, 3363 nt, Artificial Sequence
  Cas9 variant
augggacucgauauaggggucgccaguguaggcuucucaguacuagauauagacaaaggcaaaguaauugaacuaggggcaaggcuguucucagcaaccguagcagcuggaaaccaagauagaagggacaugagaggagcacgcagacuccugaauagaaacaaacaaagacgccaagacacugggaaacuuuuuaaaaaauuuggacuaauugaugacuucgauaagggaucauucuacgauaacuucaaccaaaaccuuaacccauaugaacuaaggguaaaaggccuaaccgaacaacuaacaaaagaagaguuagcagaaaguuuauaccaaauagucaaacaucgcggaauaagcuaugcacucaaagacgcagacguagaugaaggaggaacagacuacagcguaagucucaagauaaauucucaagaacucgccgaaaaaacccccgcacaaauacaauuacaaagauuaaaugacuacggaaaaguuaggggacaaguaguaauaggagaugacccagacaaccaaaaaguccugcuuaacguguuccccaccagugcauacgaaaaggaagccaaacaaauaauagcaacccaacaacaauucuacccagaaaguuuaacggauaaguuuacugaagaauauugucaaauauuaacacgcaaaagagacuauuucgucgggcccgggaacgaaaaaagcagaaccgauuauggaauauacaaaacugacggacguacacucgauaacuuauucgaagaauugauaggacaugauaaaauuuauccagaagaguuaagagcaucugcugcuaguuauacagcacaauuauuuaauguuuuaaaugaucuaaacaaccuaagaauuuugaauuaugaagacgguaaacuaacaaaagaagacaaagagaaaauaaucgcagaaauuaaaaauaauacgacaacaauaaauaugcuaaauguaaucaaaaaaguugcaggcuguucaaaagaugauauaaaaggauuuagaguaaacgaaaaagacaaaccugaaauaucauccaugccuguguacagaaaaauccauaaagauuuguuaaaagcgggaguagacauaucagauuggccaguagaauucauugacgagcuaagcuuuauucuaacacuuaauacagaaaauggagaaauaagaaaacaacucaacaauagacucgcaccaaaauuugauuuccucaacgcugauuuaauacaacucauaauagauaacaaggacucauucgaaauaaaaaccaacaauaaguggcaucgauucuccgugaaaacaaugaauaaauuaauuccagaaaugauggaaaggccaguagaacaaaugacauuauuaaacgaaaugggauuaguaaaaaaagauaagaaaagguuugaaaauaauaaauaucuaccguacaaagaaauagcaaaagauauauuuaacccuguagcuuccaaaucaguaagggaagcuuuaaaaauaguaaacgcaguucucaaaaaauacggacacauagauuaccuaguuguagaaaugccgcgcgauaaaaacuuaaaagaagaacaagauaauauaaaagaauuccaaaacaaaaacaaaaaagcaaaagaugcugccuucgaggcuuuuguaaaaagcguuggaucggaacaaagaguuaaagaagcgcuaagcaaaaaccgaaaacuccaaaugaaaaugagacuuugguaccaacaacaggaaaucgacccuuauaauggaaaaacaaucgacgcgaccgaucuaaucaacaaucccgacaaauuugaaauagaccacauaauuccgcagagcaucuccuuuuacgauuccauaaacaauaaaacccuguguuucgcaagcaugaaucaagucaaagggcaaaaaacaccauacgaauucaugcuagaaggacauggacaaucauacgacaaauuuaaagcaacagugauggcaaauaagaacuucggaaaagccaaacgagcaaacuacuuauuugaagaaaauguaucugacauugaaaccaggaaaagauuccugucucgaaacuuggucgacacaagguacagcucuagaguaguacuaaauucacuccaagacuuuuucagagaaaagucugcagacacaaaaguaaccgucauaagagggaaauucacuagcaacaugcgcaaacauuggcacauagacaaaaccagggaaaccuuccaccaccacgcaauagaugcaucaauuauagcagcuacacccuuccuacgcauguggaaaaaagguggcacaaucuucccaguaaaaguuggcgaggaaucaauagacauagaaacaggagaaauauuggacgacaaaaacuuugauaaagcaauguacgaagagccuuacucaggauucguuucagaaauaaugaacgcugacgacagaaucaaauuuucacaccagguagacaaaaaaaugaaccguaaagucucggaugccacaauuuacaguacaagaacagguaaacuugcgaaagacaaaaaagacgcagaauacauaguggcgaaaguuaaagauauauauaguguagacgguuuuaagaaauuuaaaaaaguauacgauaaagacaagaccaaauuccugcuauacaaauacgacccaagaacauuuaguaaacuagagcgaauaauaucugacuguccggauaaaguagaaaaaguacaaacaaacggaaaagucaaagcaguagacauaucaccauuugagauguacaggagagaccacgguaugauuaaaaaauauaguaaaaagggcaacgguccugcaaucaaacaacuaaaauacuuagacaaaaaacugggcucccauauagauaucacgccggcuaacgcaaacggaaaacacguaauccuacaaaguuuaaaaccauggaggaccgacguauaccuaaaccaugagacaggagaauacgaaaucauggguaucaaauacucagacuuaaaguucaauaaaaaugaaggauaugggauaaaaaaagacaaauauuuagaaauaaaaaaagucgaagaaguaucagaaaaauccgaauucauguucagccuuuauagaaaagacagaguaaaaguccaagauaugaaaacaggggaaagcguugaacuucuauucugguccagaaacuucagcaacaaaaaauacgccgaacuaaaaccaauuagucaagcagaaaacgauaagaaacuuccaguauacggaaaaggacgccuaauaaaaagauuaauaccaaaaaacugcaaaauauggaaaguuaacacaacuauauuaggcgacccauacuaucuggaaaaagaaucagauucgccuaaagauauacuggacuga

SEQ ID NO: 5099 - RNA, 3366 nt, Artificial Sequence
  Cas9 variant
augagcgaucuaguuuuaggacuugacauaggaauaggcagcgucggaguaggcaucuuaaauaaaguaacaggugaaauaauacauaaaaauucacguaucuuuccagcagcccaagcagaaaauaacuuaguucgccggacaaacagacaaggccgaagacucacaagaaggaagaaacacagaagagucagacuaaaccgacucuucgaagaaucaggacugaucacagauuucacaaaaaucucaauuaaccuaaacccauaucaauuacgagugaaaggacuaacagaugaauuaagcaacgaagaacuauuuauugcccuuaaaaacaugguaaaacaucgagguauaucauacuuagaugacgcgagcgacgauggcaauucaagcauaggagacuacgcacaaauagucaaagaaaacaguaaacaauuagaaacaaaaacaccaggucaaauccaacucgaaagauaucaaacuuaugggcaauuacguggcgauuuuaccguagagaaagauggaaagaaacauagauuaauaaauguuuucccaacaucagcauaucguucagaagcacuuagaauauuacaaacacagcaagaguucaauccccaaauaacagaugaauuuguaaacagauaucuagaaauauuaaccggaaaacgaaaauacuaccaugguccaggaaacgaaaaaucaagaaccgauuaugguagauaucgaacuaacggagaaacauuagauaacauuuucgguauacugaucggaaaauguaccuuuuauccagaugaguuccgagcggcuaaagcaagcuacacagcccaagaguucaacuuacuaaaugauuuaaauaaccuaacggugccaacagaaaccaagaaacugagcaaagaacagaaaaaccaaaucauaaacuauguuaaaaacgaaaaagcaaugggaccagcuaaacuguuuaaauacauagcaaaguuauuaagcugugacguagcugacauaaaaggauaccgaaucgacaaaagcggcaaagccgaaauacacacauucgaagcauauaggaaaaugaaaacacuggaaacgcuggacauagaacaaauggaucgagaaacauuagacaaacucgcuuacguacuuacacuuaacaccgaaagggaaggaauccaagaagcguuagaacaugaguucgcugacggaucauucucacaaaaacaaguagaugagcuaguccaauuccgaaaagcuaacaguaguauauucgguaaaggcuggcacaacuuuagcguaaagcuaaugauggaauugaucccagaacuuuaugaaacuagcgaggaacaaaugacaauauuaacaagacucggaaaacagaaaacuacaucaucaagcaauaaaaccaaauauaucgaugaaaaauuguuaacagaagaaaucuauaacccaguaguggccaaguccguaagacaagcaauaaaaauaguuaacgcagcaauuaaagaauacggagacuucgacaauauaguuaucgaaauggcaagagaaacaaacgaagacgacgaaaagaaagcuauacagaaaauacaaaaggcuaacaaggaugaaaaagaugcggcaaugcuaaaggccgccaaccaauacaacgguaaagcagaauuaccccauagcguuuuucacggccauaaacaacuagcaacaaaaauccgucucuggcaucaacaaggagaacgauguuuauacacgggaaaaacaauaucaauacaugaccucaucaauaauucaaaccaauucgaaguggaucauauacuaccacuaucaauaacauucgacgacucuuuagcaaacaaaguccuaguauacgcgacagcaaaucaagaaaaaggacaaagaacaccauaccaagcauuagacuccauggacgacgcauggagcuucagagagcugaaagcauuuguaagggaaaguaaaacacuaagcaacaagaagaaagaauacuuauuaacagaagaagauauuucgaaauucgacguccgcaagaaauucaucgaaagaaaucuaguagauacaagauacgcaucaagaguaguauuaaacgcccuccaagaacacuuuagagcacauaaaauagauacaaaaguuucaguaguaagaggacaauucacaagccagcuacgacgacacuggggaauagagaaaacaagggacacauaucaucaucacgcuguggaugcacuaaucauagccgcaucaucacaacuaaauuuguggaagaaacagaaaaauacauuagugagcuauucagaagaccaauuauuagacauagaaacuggagagcuaauaagcgaugaugaauacaaagaauuuguauuuaaagcaccauaccaacacuuuguugauacacuaaaaagcaaagaauuugaagauucuauauuauuuuccuaccaaguagauucaaaauucaacagaaaaauaucugacgcuaccauauacgcuaccagacaagccaagguaggcaaagauaaagcagacgaaacguacguacucggaaaaauaaaggacauauauacacaagacggauaugacgcauuuaugaaaauauauaagaaagacaaaagcaaauuccuaauguacagacacgacccgcaaacauucgaaaagguaauagaaccaauucuagaaaacuacccaaacaagcaaaugaacgaaaaaggaaaagaaguuccaugcaaccccuuccucaaauauaaagaagaacacggguacauacgaaaauauaguaagaaaggcaacggaccggaaauaaaaaguuuaaaauacuacgacucaaaacucgggaaccauaucgauauaacuccaaaagacagcaauaauaaaguaguccuacaaaguguuagcccauggcgagcagauguauauuuuaacaacacaacagguaaauacgaaauacuaggacucaaguacgccgaccugcaauuugaaaaaggcacgggaacauauaaaauaucacaagaaaaauacaaugauauaaagaagaaagaggguguagauagugauagcgaauuuaaauucacauuauacaaaaaugauuuacucuuagucaaagaaacagaaacaaaagaacaacaauuauuccgauuuuuaucaagaacuaugccuaaacaaaaacauuauguugaguuaaaacccuaugacaaacaaaaauuugaagguggagaggcacuaauaaaaguacuaggaaauguggcuaacggagggcaauguauaaaaggucucggaaaaucaaauauaucgauauacaaaguuagaacagacguauuaggcaaccaacacauaaucaaaaacgaaggagauaaaccuaaacucgauuuuuga

SEQ ID NO: 5100 - RNA, 3366 nt, Artificial Sequence
  Cas9 variant
augaacggccuaguacuuggauuagacaucggaauagcuucaguagguguaggcauacuagagaaaaacagugggaaaauuauccacgcaaacaguagauuauucccagcggccacagcggacaacaacguagaaagacguaaaaacagacaagccagaagacuaaacagacgaaagaaacaccgaggugugagauuccaggaccuguucgaagacuacggauuauuaacugauuuuucuaaaguaucgauaaaucugaauccauacagguuaagaguagacggccugaacaaacaacuaacgaaugaagaacuauucaucgcucugaaaaacaucguuaaaagacgcggcauaaguuauuuagacgacgcuucagaagacggaggaacagucaguagcgauuauggaaaagccgucgaagaaaaccgaaaauuauuagcagaacaaaccccaggacaaauacaacuugaaagauucgaaaaauauggacaacugagaggagacuucacagucguagaaaacggcgaaaaaugcagauuaauaaauguauucagcacaagcgcauacaagaaagaagccgaaagaauauugagaaaacaacaagaguuuaauaguaaaauaacggacgaguucaucgaagauuaucuaaaaauacugacaggcaaaaggaaauacuaucacggacccggaaacgaaaaaucaaggacagauuauggccgauucagaaaagacggaaccacguuagauaacauauucggcauacucauuggaaaaugcacauuuuacccaaacgaauacagagccucaaaagcauccuauacagcccaagaguucaaccuacugaaugacuuaaauaaccuaagcgucccuacggaaaccaagaaacuaagugaagaacagaagaaaacaauaauagaauaugccaaaucggcgaaaacacuaggcgcuucaacgcuucuuaaauacauagcaaaaaugauagacacaagcguagaccaaauaagaggauauagaguagacguaaauaauaaacccgaaaugcacacauuugaaguauauagaaaaaugcaaagucuagaaacaauaucuguaggcgaacuaagcagaaauguucuagaugaacuugcacauauacuaacauuaaauaccgagagagaaggaauagaagaagcuaucaauacuaaacuaaaagauaguuuuucucaagaccaaguauuagaauuaguacaauuuaggaaaaacaacucaucuuuauuuucaaaaggcuggcacaacuuuagucuaaaacucaugauggaauuaauaccagagcuauaugagacaucagaagaacaaaugacaauuuuaacaagauuaggaaaacagaaaucaaaagaaacuucaaaaagaaguaaauacauagacgaaaaagaauuaacggaagaaaucuacaauccaguaguagccaaaaguguucgacaagcaauuaaaauaaucaaugaagcaacaaagaaauacggaauauucgacaauauagucauagaaauggcccgagaaaaugacgaagaggacgcaaagaaagacuacauaaaacgccaaaaagcuaaucaagaugagaaaaacgccgcuauggaaaaagccgcauuucaauacaacggaaagaaagaauugccagacaacauauuccauggccauaaagaacuagcaaccaaaauacgacuguggcaccaacaaggggaaaaaugccucuauaccggaaaaacgauacccauaucggaccuaauacacaaucaauacaaauaugaaauagaccauguccuuccauuaagccuaucguuugaugacucacugagcaauaaagucuuaguacuagcuaccgcaaaccaggaaaaaggccaacgcacgccauuucaagcacuagauucaauggaugacggauggagcuacagagaguucaaaagcuauguaaaagaaucaaaauuacuaggaaacaaaaagaaagaauaucuacuaacagaagaagauauaucuaaaaucgaaguaaaacagaaauucauagaacgaaacuuagucgauaaucgguacagcucaagagucguccucaaugcccuacaagacuucuacaaagcucacaaauuugacaccacaauaucagucgucagaggacaauucacgucgcaauugaggcgaaaauggggauuagaaaaaucacgagaaacguaccaucaccacgccguagacgcguuaauaaucgcagcaucaucucaauugagauuguggaagaaacacaacaaucccuuaaucucauauaaagaaggaagauucauagacucagaaacaggugaaauuauaagccuaagcgaugacgaauacaaagagcuagucuucaaagcacccuaugaucacuucguugauacuuuaagaaguaaaacauuugaagacuccauauuauuuaguuaccaaguagauucaaaauauaauagaaaaauuucagacgcaacaauauaugcaacaagaaaagcaaaacuugacaaagacaaaucggaagaaacuuacgucuuaggaaaaauaaaagauauauacucacaagcaggauaugaugccuuuauaaaaaucuacaauaaagacaaaucuaaauuccucauguaucacaaagauccucaaacauucgaaaaagucauagaagaaauauuaagaacauacccaucuaaagaacuuaacgauaaaaacaaagaaauaccgugcaacccguucgagaaauaucgacaagaaaaugguccaauuagaaaauauaguaagaaagguaacggcccagaaauaaaauccaugaaauacuacgacaaaaacaucccugaguccuucaucaauauaaccccgucuaauucaaauaacaaagucuuacucagacaauuauauccauggcgaacagauguuuacuuuaauccacaaacagacaaauaugaacuacuugggcuaaaauacgccgacuuacaauucgaaaaagcaacaggaaaauauagcauaacuauagacaaguauaaugaaaucaaagaaaaagagggaguaucaaaagaaucagaguucaaauuuacacuguacaaaaacgaccuacuauuaauuaaagacaccaaaaauaacgaagaacaaauauuccgcuucuuaucacguacaaugccaaaucaaaaccacuauguagaauuaaaaccuuacgauaaagggaacuucgaaggcaaagaaaagauuaaagucuucaaaaugacaucuaauggacgauguauaaaaggcuuaggaaagaaauaccuuucaauauauaaaguaaaaacggacauacuaggaaacaaacauuucauaaagaaagaaggagacgaaccuaaauugaaauucuga

SEQ ID NO: 5101 - RNA, 3366 nt, Artificial Sequence
  Cas9 variant
augaauggacuuguucugggucuagacauaggcauagcaucaguuggcguagggaucuuagaaaagaacagcgggaaaauaauacacgcuaacucucgucuuuucccagcagcaacagcagauaacaacguugaaagacgaaagaaucgacaagcccgaagauuaaauagaaggaagaaacacagaggaguaagauuccaagaccuauuugaagacuacggauuauuaacagauuuuaguaaagucagcaucaacuuaaacccauauagauuaagaguagacggacuuaaccagcaauuaacuaaugaagaauuauuuaucgcauugaaaaacauaguaaaacggcgcgguauaagcuaucuagacgaugccagugaagaugguggggcaguaaguucugauuauggaaaagcaguagaagaaaauagaaaacuacuugcagaacaaacuccuggacaaauacaacuagaaagauuugaaaaauauggacaaguaagaggcgacuucacuguaguagaaaauggcgaaaaacguagauuaauaaaugucuuuaguacgagcgcauauagaaaagaagcugagaaaauacuaagaaaacaacaagaguucaauaaucaaauaacagacgaguucaucgaagauuacuuaaaaauucucacuggaaaacgaaaauacuaccauggacccggaaacgaaaaaucaagaacagacuauggacgauucagaacagacggaacaacacuagauaacaucuucggaguauuaauaggaaaaugcacauuuuaccccaaugaauacagagcaucaaaaucaucauacacugcacaagaguucaaucuacuaaacgacuugaacaauuuaacaguaccaacugaaaccaagaaauuaucagaagaacagaagaaaguuauagucgaauacgcuaaagaagcaaaaaccuuaggagcaagcacauuauugaaauacauaguaaaaaugauagacgcauccguagaccaaauaaguggcuaucguguagauguaaauaacaaaccagaaaugcacaccuuugaaguauauagaaaaaugcaaucacuagaaacgauaagugucggcgaacuuucuaggaacguuuuagacgaauuagcgcauauauuaacuuuaaauacagaacgcgaagguauugaagaagcaauaaauaguaaacuuauggguguauuuucacaagaucaaguccucgaacuuguucaauuccguaaaaacaauucaucauuauucucuaaaggauggcauaacuuuagcuuaaaauuaaugauggaauugauaccugaauuauacgaaacaucugaagaacaaaugacgauacucacucgacugggaaaacagaaaagcaaagaaacaagcaaacgaacaaaauacauagaugaaaaagaacucaccgaagaaauauacaacccaguaguagcaaaaaguguacgucaagcuauaaaaauaauaaacgaagcaacaaagaaacauggaauauuugauaauaucguaauagaaauggcgcgcgaaaacaaugaagaagaugcaaagaaagauuacauaaaaagacaaaaagccaaucaagacgagaaaaacgcugcgauggaaaaagcugcuuuucaauacaauggcaagaaagaacuaccuggcaauauauucaauggccacaaagaauuagcaacaaaaauucgauuauggcaucaacaaggggaaaaaugccuauauacaggcaaaacaauaccaaucucagauuugauucauaaucaauacaaauaugaaauagaccacauacuaccacuuagccucagcuucgacgacagccucucuaacaaaguucuaguucacgcgacggcuaaccaagaaaaagggcaacgaacaccauuccaggcuuuagauucaauggaugacgcauggucauaccgagaguucaaauccuauguaaaagaccucaaaucgcucucaaauaaaaagaaagacuaucuauuaacagaagaagauauaucaaaaauagaaguuaaacaaaaauucauagaacgaaaccucguagauacccgauauagcucaagaguaguccuaaacgcacugcaagacuucuauaaaucacaucaauucgacacuacaaucagcguuguaaggggccaauuuacaucccaacuccgacgaaaauggggccuagaaaaaucaagagaaaccuaccaccaccacgcaguugaugcacuaaucauugcagcaucaucacaacugagacuauggaagaaacaaaacaacccucuaauaacauauaaagaaggacaauuuauagacagucaaacaggagaaauaauauccuuaacggacgacgaauacaaagaauuaguguucaaagcaccuuaugaucauuucgucgacacauuacacucaaaaacuuucgaagacggaauacuauucuccuaucaaguagacucuaaauacaaccggaaaauuucagacgcaacaauauaugcaacuagaaaagccaaacuagauaaagacaaaagugaagaaacauacguauuggguaaaauuaaagauauauacucacaagcagguuacgaugccuucauuaagauauauaauaaagacaaaagaaaauucuuaauguaucauaaagacccccaaaccuuugaaaaaguaauagaagaaauauuaagaacauaucccaguaaagaaagaaacgacaaaaacaaagaaguaccuuguaacccguuugaaaaguaucgucaggaaaacgguccaauaagaaaguauucaaagaaaggaaacggaccagaaauaaaauguuuaaaauacuaugacaauaaacugggcaauuauauagacauauccccggauggauccgacaaucaaguaguacuacaaucuuuaaaaccauggagaacagauguauacuucaaccaccagacuaagaaauacgaacuaaugggcuugaaauacagugacuuaucauuugaaaaaggaagcggaaaauacucuauaucaaaugaaaaauauaauagcauaaaacgaaucgaagguguaaaugaacaaagcgaguucaaauucacuuuauacaaaaacgaccuaauucuaauuaaagauucagaaaacaaugaacaaaaacucuucagguuuaauucaagaaacgacacagccaaacauuacguugaacucaaaccauacgauaaagcaagauuugacggccaacaggaacugauaacaauauuaggaaauguagcaaaaggaggacaauguuuaaaaggauuaaauaaaucaaauaucaguauauucaagguaaaaacugacguacuugguaagaaacacauaaucaaaaaggaaggggacgaaccaaaacucaaguucuga

SEQ ID NO: 5102 - RNA, 3366 nt, Artificial Sequence
  Cas9 variant
augagcgaccuaguacuaggguuagacauaggaauaggaagcgugggaguaggaauauuaaacaaaguaacaggagaaauaauacauaaaaauucaagaauauuucccgcagcccaagcagaaaacaaucuuguaaggagaacaaacagacaaggaagaaggcuaaccagacgcaagaaacauagaauaguacgucuaaauagacuauuugaagaaucgggauuaaucacagauuuuacaaaaauuagcauaaaccuuaacccauaucaauugagaguaaaaggucuaacagacgaacuaucaaacgaagaauuauuuauagcacuaaagaauaugguaaaacaucgaggaauaucuuacuuagacgacgcguccgacgacggaaacuccucuguaggagacuaugcacaaauaguaaaagaaaacucaaaacaacuagaaacuaaaacgccaggacaaauucaacuagaaagguaccaaacauacggacaacuacgaggagauuucacagucgaaaaagauggcaagaaacaucgacuaaucaauguauucccaacaucggcauacaggucagaggcuuuaaggauacugaaaacccaacaagaguucaauccacaaauaaccgaugaauuuauaaaccgcuacuuggaaauacuaacaggaaaaagaaaauauuaccauggcccuggcaaugaaaaaucacgaacugauuauggucgauacagaacuaauggagaaacauuagauaacauauuuggcauauugauuggaaaaugcacauucuacccagaagaauuuagagcggcaaaagccucauacaccgcacaagaguucaaucuccugaaugauuuaaauaaccugacaguaccaacagaaacaaagaaacucucuaaagaacagaaaaaccaaauaauaaacuacgugaaaaaugaaaaagcaaugggaccagccaaauuguucaaauauauagcaaaauuacuaucaugugacguagcagacauaaaaggcuacagaauagacaaaucagggaaagcagaaauccacacguucgaagccuaucgaaaaaugaaaacacucgaaacucuagauauugaacaaauggacagagaaacgcuugauaaauuagccuauguucuaacccuaaacaccgaacgagaaggaauacaagaagcacuugaacacgaauuugcagaugggucauucucacaaaaacaaguagacgagcuaguccaauuuagaaaagcuaacaguucaauauuuggaaaaggauggcauaacuucuccguaaaacuaaugauggaauuaauucccgaacucuaugaaacuucggaagaacaaaugaccauacuuacuagauugggaaaacagaaaaccacauccucuagcaacaaaacaaaauacauugaugaaaaauuauuaacugaagaaauauauaauccagugguagcaaaaucaguuaggcaagcuauuaaaauaguaaaugcagcuauaaaagaauacggagacuuugacaacauugucaucgaaauggcuagagaaacaaaugaagaugacgaaaagaaagcaauucagaaaauacaaaaagcaaacaaagaugaaaaagacgcagcaaugcuaaaagcagcaaaccaauauaacggaaaagcugaauuaccacauucagucuuccacggacauaaacaacuagcgacuaagauccgccucuggcaccaacaaggagaaagaugccuauacacaggcaaaaccauaucaauacacgaccuaauaaauaauccaaaccaauucgaaguagaccacauccuaccauuauccauaacauucgacgauucccuagcaaacaaaguucuaguauacgcaacagcaaaccaagaaaaaggacaacgcaccccauaucaagccuuagacagcauggaugacgcaugguccuuccgagaacuaaaagcauucguaagagaauccaagacauuaagcaacaaaaagaaagaauaucuacuaacagaagaagauauaaguaaauucgauguccaaaagaaauucauagaaagaaaccucguagauacaagauaugcaucacgaguaguauuaaacgcucuccaagaacacuuuagagcacacaaaauagacaccaaaguaagcguaguucgggggcaauucaccucucaauuaagaaggcauuggggaaucgagaaaacacgagauacauaccaccaucaugcgguagacgcccuaauaauagcugcuaguucgcaacuaaaccuuuggaagaaacagaaaaacacccuaguaucauacucagaagaccaauuacuagauauugaaacaggugaacucauaagcgaugaugaauacaaagaauccguuuucaaagcacccuaccaacacuucguugauacacuaaaaagcaaagaguucgaagauucuauccucuucucauaccaagucgacucuaaauucaaucgcaaaauaucagacgcaacaauuuacgcuacaagacaagccaaaguaggaaaagacaagaaagacgaaacauauguuuuagguaaaauuaaagacauuuauacucaagauggcuacgaugccuucaugaaaauauauaagaaagacaaaucgaaauuuuuaauguacagacacgacccccaaacauuugaaaaaguaauagaaccgauacuagaaaacuacccuaacaaagaaaugaacgaaaaaggaaaagaaguccccugcaacccauuuuuaaaauauaaagaagaacacggcuauauaaggaaauauucaaagaaagguaauggcccagaaauaaaaucauuaaaauauuacgacucaaaacugggaaaccauauagacauaacacccaaaaacucuaacaacaaagucguacuacaaucaguaucacccuggagagcugauguauauuuuaacaaaacaacuggaaaauaugaaaucuuaggcuuaaaauaugcagauuuacaauuugaaaaagguaccgggaccuauaaaaucucacaagaaaaauacaacgauauuaaaaagaaagaaggagucgauagugacucagaauuuaaauuuacuuuauacaaaaacgaucuacuauuaguaaaagacacagaaaccaaagaacaacaacuauuuagauucuuaucaagaacuaugcccaaaaagaaacacuaugucgaauuaaaaccauaugacaaacagaaauuugaaggaggcgaagcgcuaauaaaaguucuagggaacguagcaaacucaggccaauguauuaagggcuuagcaaaaucaaacaucucuauuuauaaaguaagaacugacgugcucggaaaucaacacauaaucaaaaacgaaggagacaaaccaaaacuagacuucuga

SEQ ID NO: 5103 - RNA, 3366 nt, Artificial Sequence
  Cas9 variant
augucagaccuaguucuaggacuagauauaggaauaggaagcgucggcguagggauauuaaacaaaguaacaggugaaauaauucauaaaaacagucggauauucccggcagcccaagcugaaaacaaccuuguuagaagaacaaauaggcagggaagaagauuaacacgaagaaagaaacacagaagagugagacuaaauagacuauucgaagaaucaggauuaauaacagauuuuacaaaaauaaguauaaaucuuaauccauaccaacuacgaguaaaaggccuaacagaugaacucagcaaugaagaauuguucauagcauuaaagaacaugguaaaacaucgcgguauaucuuauuuagacgacgcaucggacgaugguaacaguucgauaggggauuacgcccaaauaguuaaagaaaacucaaagcaacuagagacaaaaacaccuggacaaauacaacucgaaagauaucagacauauggacaacuaagaggagauuucacaguagaaaaagacgguaagaaacacagauuaauaaacguauucccgacaucagcauauagaagcgaggcacuaagaaucuugcaaacucaacaagaauuuaauccgcaaauaaccgacgaauuuaucaaccgauauuuagagaucuuaaccggaaaacgaaaauacuaccacggaccaggcaaugaaaaaucgcgaacagauuacggucguuacagaacaaguggggaaacucuggacaacauauucggaauauugauagguaaauguacauuuuaccccgacgaguucagagcagcuaaagcaagcuauacugcacaagaguuuaaccuccuaaacgaccuaaauaaucuaacgguuccuacugaaacaaagaaacuuuccaaagaacagaaaaaccaaaucauaaacuaugugaaaaacgaaaaagccaugggaccagccaaacuauucaaauauauugcaaaacuauuaagcugugauguggcagacauuaaaggcuacagaaucgacaaaucuggaaaggcagaaauacauacguucgaagcauaucgaaaaaugaaaacccuugaaacacuagauauagagcaaauggauagagaaaccuuagacaaacuugcuuauguacuaaccuuaaacaccgaaagagaaggaauacaagaggccuuagaacaugaguucgcagauggaucauucagccaaaaacaaguugacgagcuagugcaauuuaggaaagcaaauucuucaauuuucggaaaaggauggcacaacuuuaguguaaaacuaaugauggaacugauaccagaauuauaugaaacaucagaagaacaaaugacaauacuaacuaggcuugggaaacagaaaacaaccaguaguucaaacaaaacuaaguacauugacgaaaaauuauuaacggaagaaauauacaaccccguaguggcgaaaucaguaagacaagcaaucaaaaucguaaaugcagcuauuaaagaauacggagauuuugauaauauugugauagaaauggcacgagaaacaaaugaagacgaugaaaagaaagcaauacagaaaauacaaaaagcaaacaaagacgaaaaagacgcugcaaugcuaaaagcagcaaaucaauacaauggaaaagcagaauuaccccacucaguauuccaugggcauaaacaacucgcuacaaaaauaagacuauggcaccaacaaggugaaagaugcuuauacacuggcaaaaccaucucaauucacgaucuaauaaauaauuccaaccaauucgagguagaucauauacucccccuaucuauaacuuuugaugacucauuagcaaauaaaguauuaguauaugcaacagcaaaucaagaaaaaggacaaagaacaccauaccaagcacuagauagcauggaugaugcauggucguucagagaguuaaaggccuuuguaagggaaagcaaaacauuaucuaacaagaagaaagaauacuuguuaacagaagaggacauuucaaaauuugacguccgcaagaaauuuauagaacgcaauuuagucgacacacgauaugccucccgaguaguacuaaaugcuuuacaagaacacuuccgagcacacaaaaucgacaccaaaguaagcguaguaagaggucaauucaccagccaacucagaagacacuggggaauagagaaaacaagagacacauaccaucaccaugcaguugacgcauuaauaauugcugcaucaucucaacuuaaucuauggaagaaacagaaaaauacguuaguauccuacagugaagaucaacuccucgacaucgaaacaggcgaauuaauuagcgaugacgaauacaaagaaagcguauuuaaagcgccuuaccaacacuucguagacacauuaaaaucuaaagaguucgaagacagcauacuauucaguuaucaaguagacaguaaauuuaauagaaaaauaucagacgcaacaauauaugccacaagacaagcaaaaguggguaaagauaaagccgaugaaacauacguacuaggaaaaauaaaggacauauauacccaagacggauaugacgcauuuaugaaaauauauaagaaagauaaaagcaaauuccucauguauagacacgauccccaaaccuucgaaaaagucauagaacccauacuugaaaacuacccuaacaaacaaauuaacgaaaaagggaaagaaguaccauguaacccauucuuaaaauauaaagaagaacacggcuacauaagaaaauauucaaagaaaggaaauggccccgaaaucaaaucgcucaaauacuaugacucaaaauuagggaaccacauagauauaacaccuaaagauaguaauaacaaagucguacuacaaucagucagcccuuggagggcagauguauauuucaacaaaacaacaggaaaauacgaaauacuagggcuaaaauacgccgaucuccaauucgaaaaaggaaccgggacauauaaaauaagucaagaaaaauacaaugauaucaaaaagaaagaagggguagacagcgauagcgaguucaaauuuacauuauacaaaaacgaccucuuauuagucaaagauacugaaacuaaagaacaacaacuauucagauuccuuaguagaacaaugccaaaacaaaaacacuacgucgaacuaaaaccauacgauaaacaaaaauucgaaggaggcgaagccuuaauaaaaguucuagguaaugucgcuaacaguggacagugcaagaaaggacuaggaaaaucuaacauaaguaucuacaaaguaagaaccgauguauuagguaaccaacauauaauuaaaaaugaaggagauaaaccaaaauuagacuuuuga

SEQ ID NO: 5104 - RNA, 3366 nt, Artificial Sequence
  Cas9 variant
augagcgaccuaguauuagggcuugacauaggaauaggaucaguaggagucggaauacucaacaaaguuacaggagaaauaauacacaaaaacucgaggauauuuccagccgcccaagcagaaaacaaccucguuagacggacgaacagacaaggaagaagacuaacgcgaagaaagaaacaccgcagaguacgacuaaaccgacuuuucgaagaauccggacuuauaacagauuucacaaaaauaucaauaaaucugaauccauaucaauuacgaguaaaaggguuaacagaugaacuaucaaaugaagaacuauuuauagcccucaaaaacaugguaaaacaucgagguauaucauauuuagacgacgcaucugaugaugguaacagcucagucggagacuaugcacaaauagucaaagaaaacucaaaacaauuagaaacaaaaacaccaggacaaauacaacuagaaagauaucaaacauauggucaauuaagaggcgacuucacugucgaaaaagaugguaagaaacaccguuuaaucaauguauuuccaacaagcgcauaucgauccgaagcacuaagaauacuccaaacucaacaagaguucaacccccaaauuacugacgaguucguaaauagauaccuagaaauucuaacaggaaaaagaaaauauuaccaugggccaggaaaugaaaaaucacgaacggacuauggaagauauaggacaaacggagaaacacucgauaacauuuuuggaauauuaaucgggaaaugcacauuuuauccagaagaauuuagagcagcuaaagcaaguuauaccgcacaagaguucaacuuacuuaacgaucugaauaacuuaacaguacccacugaaaccaagaaauuaucaaaagaacagaaaaaucaaauuaucaacuaugucaaaaaugaaaaagcgaugggaccagccaaacuauuuaaauacauagcuaaacuccuuucaugcgauguagcagauauaaaaggauaccgaauagacaaauccggaaaagcagaaauucacacauucgaagcauacaggaaaaugaaaacauuagaaacccuagacauagaacaaauggaucgugaaacauuagacaaacuagcauacguacuaacacuuaacacagaaagagaaggaauacaagaagcauuggaacacgaguucgcugacgguagcuuuucucaaaaacagguagacgaauuaguacaauucagaaaagcaaacucaucaaucuucggaaaaggauggcauaauuucagugugaaacugaugauggaacuuauuccugaacuauaugaaacgagcgaagaacaaaugacgauacuaaaacgauuaggaaaacagaaaacaacuagcaguaguaacaaaacgaaauauauagaugaaaaacuacuuacagaagaaauauauaauccagucguugcgaaaucaauuagacaagcaauaaaaauuguaaacgcagcaauaaaagaauacggagauuuugacaauaucguaaucgaaauggcacgagaaacaaaugaagaugaugaaaagaaagcgauucagaaaauacaaaaagcgaacaaagacgaaaaagaugcugcuaugcugaaagcagcgaaccaauauaacggaaaagcugaacuaccucacuccguauuccauggucacaaacaacuagcaacaaaaauuagacuguggcaccaacaaggagaacguugcuuguacaccggaaaaacaauaagcauacacgaccuaauaaacaauccaaaucaauuugaaguagaucacauauuaccccuaucaauuacuuuugacgauucccuagcaaauaaagugcuaguauacgcuacugcaaaucaagaaaaaggacaacgaacgccauaucaagcccuagauucaauggacgacgcauggucauucagagagcuaaaagcauuuguaagagaaaguaaaacacuuucaaacaaaaagaaagaauauuuauuaaccgaagaggacaucucuaaauucgauguacgcaagaaauuuauagaaagaaaucuaguagacacaagauaugcaucacgaguaguccuaaaugcucuccaagaacauuuuagagcacauaaaauagacacuaaaguaucagucguaagaggacaauucacaucacaauuaaggcgacauuggggaauugagaaaacaagagacaccuaucaccaccaugcugucgacgcccuuauaaucgcagcuaguucucaauuaaacuuauggaagaaacagaaaaauacccuaguaagcuauagcgaagaccaacuuuuagacaucgaaacaggcgaauuaaucucugacgaugaauauaaagaaucaguuuucaaagcccccuaccaacauuucguagauacauuaaaaucaaaagaguucgaagacagcauucuauuuucuuaucaaguagauuccaaauuuaauagaaaaaucucagacgcaacaauauacgcaacaagacaagccaaagucggcaaagacaagaaagacgaaacuuauguacuaggaaaaauuaaagauauauacacacaagacggguacgacgccuuuaugaaaauauacaagaaagauaaaucaaaauuuuuaauguaccgacaugauccacaaacauuugaaaaagugauugaaccaauauuagaaaacuacccgaacaaagaaaugaaugaaaaaggaaaagaagucccaugcaacccauuccucaaauacaaagaggaacauggauauauacggaaauauaguaagaaaggaaacgauccugaaauaaaaagucuaaaauauuacgacaguaaacuagggaaucacauugauauaacucccaaagauucaaauaauaaaguaguauugcaauccgucaguccuuggcgcgcagauguuuauuucaacaaaacgacaggaaaauacgaaauacuuggacuuaaauaugcagaucuacaauucgaaaagggcacaggaacuuauaaaauaagucaagaaaaauauaacgacauaaagaagaaagagggaguagauagugauucggaguucaaauucacucuauacaaaaaugaucuccuucuuguaaaagacaccgaaacaaaagaacaacaauuauucagguuccuaagccguacaaugcccaagcaaaaacacuacguagaacuaaaaccauacgacaagcaaaaauucgaaggcggugaagccuuaaucaaaguauuagguaacgucgcaaacaguggccaaugcaagaaaggacuaggaaaaucaaauauaagcauauauaaaguacguaccgacguccuuggaaaccagcauauaauuaaaaaugaaggcgacaaaccaaaacuagacuucuga

SEQ ID NO: 5105 - RNA, 3366 nt, Artificial Sequence
  Cas9 variant
augaauggacuuguacuaggauuagauauaggaauagcaucaguaggggucggaaucuuagaaaaaaauagcgguaaaaucauacacgccaauuccagguuauucccugcugcuacagccgacaacaauguagagagaagaaaaaauagacaggcaagaagacuucacaggagaaaaaaacacagaggaguacgauuccaagaccuauucgaagacuauggauuguuaacugacuuuucaaaaguaaguauaaaucuaaaccccuacagacuacgugucgacggauuaaaccagcaauuaacaaacgaagaacuguuuaucgcauuaaaaaauauaguaaagagaagaggaauauccuacuuagaugacgcauccgaagauggaggaacugugucaucagacuauggaaaagcaguagaagagaaccggaaacuccucgcagagcaaacgccuggccaaauacaacuugaaagauucgaaaaauacggucaaguacggggggauuucacaguaguugaaaacggagaaaaaagacgacuaauaaauguauuuagcacuagugcauauaggaaagaagcagagagaauacucagaaaacaacaagaauucaacaguaaaauuacugaugaauuuauugaggacugccuuaaaauauuaacuggaaaacgaaaauauuaccauggucccggaaacgaaaaaagcagaaccgacuacggaagauuucgaacugacggaacaaccuuagauaacaucuuuggaauacucauugguaaguguacguucuacccagaugaauauagagcuagcaaagccuccuacaccgcacaggaauucaaucuauuaaacgacuuaaacaaccuaacuguaccaacugaaacgaaaaaacuaucagaagaacaaaaaaaaguaaucguugaauacgcuaaagaagcaaaaacacuaggagcgaguacacuauuaaaauacauugcaaaaaugaucgacgccucaguagaucagauccgaggauaccgcgucgacguaaacaacaaaccagaaauacauacguucgaagccuacagaaaaaugcaaucguuggagacaauaucaguaggagaacuaucccgaaacguucucgaugaguuagcucauauuuuaacacuaaauaccgaaagagaggguauagaagaagcuauuaacacgaaauuaaaagacagcuucagccaagaucaaguccuggaauuaguucaauuccgaaaaaacaacucaucacucuuuucaaaaggauggcacaacuucucacuaaaacucaugauggaauuaauaccagaacuauacgaaacaagugaagaacaaaugaccauacuaacaagacuaggaaaacaaaaaagcaaagaaauaagcaaacgaacaaaauauauugaugagaaggaauuaacggaagaaauauacaaucccguaguagcaaaaucaguuagacaagcaauaaaaauaaucaacgaagccacaaaaaaacacgguauauuugauaauauagugauagaaauggcucgggaaaauaaugaagaggaugcaaaaaaagauuauauaaaaagacagaaagcaaaccaagaugaaaaaaacgcugcuauggaaaaagcagcuuuucaauauaauggcaaaaaggaacuucccgauagcauauuucaugggcaaaaagaacuugcaacaaaaaucagauuauggcaucaacaaggagaaaaaugucuauauacaggaaagaacaucccaaucagugacuuaauacacaaucaguacaaauaugaaaucgaccauauucuuccacuaucccuaucguucgacgacagcuuaagcaacaagguccuagucuuagcaacugccaaucaagaaaaaggacaaagaaccccauuucaagcacuagauaguauggaugaugcauggucuuacagggaauucaaaaguuauguaaaagaaaguaaguuacuugguaauaaaaaaaaagaauauuuacuaacagaagaagacauaaguaaaauagaaguuaagcaaaaauuuauagaacgaaacuugauagacacacgcuacagcucgagaguaguucuuaaugcacugcaagacuuuuacaaagcgcauaaauuugauacaacaauuaguguagucagaggacaauuuacaagccaacuacgaagaaaaugggguuuagaaaaaucaagagaaacauaucaucaucacgccgucgaugcucucauaauugcagcgucaucacaacucagacucuggaaaaaacaaaacaacccacuaauagcauauaaagaaggccaauuuguagacagcgagacaggggaaauaauaucauuaucagacgacgaauacaaggaacuaguauuuaaagcaccauaugaucacuuuguagacacauuaaguucgaaaacauuugaagacuccauacuauucucguaccaaguugauucuaaauuuaaucgaaaaauaucagacgcaaccauauacgcgacacgaaaagcaaaauuagacaaagaaaaaagcgaggaaacauacguucuaggcaaaauaaaagacauauacagccaggcaggguaugacgcauuuauaaaaauauauaauaaagacaaaagcaaauucuuaauguaucacaaagacccccaaacauucgaaaaagucauagaagaaauucucagaacauacccaucuaaagaguuaaaugacaaaaacaaagaaauaccuuguaauccauucgaaaaguacagacaagaaaacggacccaucaggaaauauucaaaaaaaucaaauggccccgaaaucaaaucccucaaauacuaugauaauaaauuaggaaaccacauagauauaacaccugaaaguucagacaaucaaguaguacuacaaucauuaaaaccauggagaacagaugucuauuucaaccaccaaacaaaaaaauaugaacuuaugggcuuaaaguauucagacuuaucuuuugagaaggggagugguaaauauagcaucucaaaccaaaaauacaauuccauaaaacgcaucgaaggcauagaugaacaguccgaauucaaguuuacacuauauaaaaaugauuuaauauuaaucaaagacagcgaaaauaaugaacaaaaacucuuccgauuuaauagccguaacgauacugcaaaacauuacaucgaacuaaaaccuuacgauaaagcaaaauucgacggcgaacaagaauuaauuacaauuuuaggaaacguagcgaaaggaggccggugcuuaaagggguuaaacaaaucaaacauauccaucuuuaaaguaaaaacagacguccugggaaaaaaacauauaauaaaaaaagagggagacgaaccaaagcucaaauuuuga

SEQ ID NO: 5106 - RNA, 3366 nt, Artificial Sequence
  Cas9 variant
augaacggacuaguguuaggucuugacauaggaaucgccucuguaggugucgguauucuuaacaaagacacaggggaaaucauacacaccaauagccguauuuuuccggcagcaacagcagauaacaaugucgaacgacgaaacucaagacaagacagaagacuaaacagaaggaaaaaacauagaggaguccgacuacaugaucuuuucgaagacuaugaucugcucaccgauuuuucaaaaguaucaauuaaccuuaaucccuaucgacuacgaguacaaggacuugauaauucgcugacaaccgaagaacuuuucaucgcacuaaaaaauauagugaaaagacgaggaaucucauauuuagacgacgcuagcgaggacgguggaguaguaagcucagauuacggcaaagcaguagaggaaaacagaaaacuuuuagcagaacaaacaccuggucagauacaacuagaaagauuuaagaaauauggucaaguuagaggcgauuucacaguuguagaaaacggagagaaacgacgacuaaucaacguauucucaaccagugcauaccgcaaagaagcagaaagaauccuaagaaagcaacaagaauucaauaaucaaaucacagauaaauucauugaggacuaccuaaagauuuugacggaaaaaaggaaauacuaccacgggcccggcaaugaaaaaucaagaacggauuacggcagauuucguacagacgggaccacauuagacaauaucuucgggauccuaauaggaaagugcacauuuuauccgaacgaguauagagcaaguaaagcauccuacacagcacaagaauucaaccuauuaaaugaccuaaacaaccuuacgguaccaacagaaaccaagaaacuaucagaagaacaaaaaaaaacaauaguggaauaugcaaagagcgccaaaacgcuaggagcaucaacccuacucaaauacauugcuaaaaugaucgacgcauccguagaucaaauaaggggauaccgagucgacguaaauaacaaaccagaaaugcacaccuuugaaguuuaccgcaaaaugcaaucuuuggaaacuauaaguguaugggaguuaucacguaauauacuagacgaauuagcacauauauuaacacuaaacaccgaaagagaaggcauagaagaagcaauaaacacaaaacuuauggacgucuuuucacaagaucaaguauuagaguugguacaauuuagaaaaaacaacucaagccuuuucaguaaaggauggcauaacuucagcagaaaacuaaugauggagcucauaccagaauuauacgaaacaagcgaagaacaaaugacaauuuuaacaagacuuggcaaacaaaaauccaaagagacaucaaagagaacgaaauauauagacgaaaaagaaguaacagaagaaaucuacaacccuguaguagcuaaaucaguaagacaagcuauaaaaauuauaaacgaagcaacaaaaaaauacggaauuuucgauaacauugucauagaaauggcccgagaaaacaacgaagaagaugcaaaaaaagacuacauaaaaagacaaaaagcaaaucaagaugaaaaaaacguugcaauagaaaaagcagcauuucaauauaacggcaaaaaagaacuacccgauucaaucuuccauggacacaaagaacuagcuacaaaaauaaggcuuuggcaccaacaaggagaaaaaugcuuauauacaggaaaaaacaucccaauaucagaccuaauucauaaucaauauaaguacgaaauagaucacauacuaccccuaucguuaaguuuugacgauucacuauccaauaaaguauuaguauuagcaaccgcaaaucaagaaaaaggacagagaacuccauuucaagcauuagauaguauggacgacgccuggagcuauagagaauucaaaucauauguaaaagacaguaaacuauuaggcaacaaaaaaaaagacuaccuccuaacagaagaagacaucaguaaaaucgaaguaaaacaaaaauucauugaaagaaacuuaguagauacacguuauucauccagaguaguacugaauacacuacaagacuucuacaaagcacauaaauuugauacgacaaucagcguuguaaggggucaauucacuucacaguuaagacgcaaauggggccucgaaaaauccagagaaacuuaucaccaucaugccguagaugcauugauaauugcagcaagcagccaauuaagguuauggaaaaaacaagccaacccuuugauuuccuacaaagaggaucaauucguagacagugaaacaggagaaauaauaagccuaacugaugacaaguauaaagaacuaguauucaaagcaccauacgcacacuuugucgacacucuguccucaaaaaaauucgaagauucaauccucuucucuuaucagguagacucgaaauauaauagaaaaauuucugaugcuacaauauaugcaacaagaaaagucaaacuagacaaagauaaaagcgaagaaacuuacguacuuggcaaaauaaaagauauuuauagucaagcuggauaugacgcguucauuaaaauauacaauaaagauaaaucaaaauuccuaauguaucacaaagacccacaaacuuuugagaaaguaauagaagaaauccugcgaauauaucccucaaaagaguucaacgaaaaaaacaaagaaguaccguguaacccguucgaaaaauacagacaagaaaacggaccaauauguaaauacagcaaaaaagggaauggaccagaaauaaaaagcuuaaaauauuacgauaaaaacauuccagagucauuuauagacauaacaccaucaaauucaaagaauaaaguuauacuacgacaacucaacccuuggcgaacagacguuuacuucaaucaccaaacugaaaaauacgaauuacuaggacucaaauaugcagaccuacaauuugaaaagaaaacagaaacauauaguauaaccaucgauaaauauaaugaaauuaaagaaaaagaaggaguaggagaacacucugaauucaaauuuacacuauacaaaaacgacuuacuacucauaaaagacauggaaauaaaagaagaacaaauauuucgauuccuuaguagaacaaugccaaacaaaaaacauuacgucgaacugaaaccuuauuacaaggguaacuucgaaggcaaagaaagaauaaaagucuucaauacaacaaguaacggaagaugcuugaaaggguuaggcaaaaaaggccuauccauauauaaaauuaaaacggacguucuuggaaauaaacauuucauaaagaaagagggagaaaaaccaaaacuuaaauucuga

SEQ ID NO: 5107 - RNA, 3366 nt, Artificial Sequence
  Cas9 variant
auggauagaacagaagucaacaucggauucgacauagguaucucaagcguaggauggucagucguagcaacuaaaucaggaaggaucuuagaaagcggagugucacuguucucaggagcuagugcagcuaaaaacgaagaacgaagaaacuucaggcaaagcaggagauuacuuaggagacgaaagaacagaauaucagauuuaaagaaauauuuaaaagagcaaaguuuuacauauaacggugaauugcuaaacgaaaacccguacgaaauucgaguaaaaggacucacagaaaaacuaucaaaagaagaaauugcacuagcauuacuucacauagucaaaaggagaggaguauccuaugaucugggcgacauugaagaggaaggaacaacagggucauacaaagaaggaguaaagaaaaaucaaaaauuacugaaagagaaaacaccggcagaaauucaauuccaaagauuaaagaaauuccacaaagucagaggacaaauagcaauagacgaaaaugauguccucuugaauguauucccuaaccacgcauacguggacgaagcccaacaaauacuguacacacaacaagaauuuuauccagaaaucaaugaaacauucauaaaccaaguuacagauuucaucucaagaaaaagggacuacuucauagggccaggcucggagaaaagucgaacugauuacggaauuuauagaacagacggaacaacccuacaaaauuuauucagcauccuaauaggaaaagacaaaaucuuucccgacgaauuuagagcugccgggaauaguuauacagcccaaguauauaaucuacucaaugaccuaaacaaccuagcuauugaugacacagaaacaggaaaauuaaccaaacaacaaaaagagaaaauaauaauggaauuaaaaacuacagaaaaaucagugaauaugaugaaacucauagcgaaaacagccggcguaacagucgaacaaaucagcagauaucgaauaaaccgggacgguaaaagugaaauacacaacauggcagucuacagaaaaaucagaaaaguauucuuagaacuaggcuacgaaaucaaugaauggccaagucagcuacuugacgaauugggagacgcuuuaagccuaaacacugaaaacggagaaaucagaagaauauuaacagauaacuuagccaacaaauacaaaauuuuagaccaacagcucauuaacuuaauuauagaaaacaaaaacgcauucaccuuaagcacaaaccaaaaauggcacagauuuucauacaaaacaaugaaaauacuaauaccagaacuacuagaaacaaacaaagaacaaaugacgauacuaacagaaaugggacuuaugaagaaagaccagagaaacuauguagggaaaaauaaaauagauucagaagcccugcuagaaaaucuguacaauccggucguucggaaauccacuagacaaaccaugaaauuauuuaacacacuacuaaagaaauacccaaauauugcauaugucguuauagaaaugcccagagaagacgacgaagauaaagcaagaagagacuauguuaaauuucaaaaagacaacgaaaaagaaaaagaugcagcccugaaaaacuuuauuauggaauccggaaaaucagaagcagaaguuauagcaaaauaccgacaaagcaagaaauuuagaaguaaaguccgauuaugguaucaacaaaugggaagaugucuauauucaggaaaggcaaugccugccgaaagaguauuuagagacgaccacuuuaccgauauagaccauguaauaccacucucaguuucauucgacgauggaaugaacaauaaaguuuugugcuuagccgaaaugaacagacaaaaagauaagcaaacuccauaugcuuucuucaacgcaggucauggacagggauuccaagcaaugaaugcaaugcuaaagaauaacaauagaaucuccucggcaaagaaaagaaacuuauuauucaccgaaaacuuaaacgaccuagaaguccgaaaaagauuuaucgaacguaaucuugucgauacaagauacgcuucacgcgucguauugaaugaauuacaacaauucguuaaagcuaaacaauuagauacaaaaguaaccguaauaagaggaaaauucacaucaaaacugagagaaaaauggaauauaaauaaaagucgagacacccaccaccaucacgcagucgacgcugcugucauagcagugucaccaauguuaaacuuaugggaaaaaggagccucaauaauaccaaacaaaguaggagaaaacguaaucgacauaaagacuggagaaauuaucacagaccaugauuacgaagcagauguauacgagcuucccuacgcaaaauuucuagaacaaauaccaaaaguaaagaaagauauaaaauucagacaccaaguagauaaaaagaaaaaucgcaaaguaucagacgcaaccauuuacacaacuagaaaagcaaaagucggaaaagacaaagaggaaacagauuacguccugggaaccauaaaagacauuuauucacuggaagguuacguuuccuucaagaaaauauacaacaaagauaaagcaaaauuccugauggcaagaauagacccaaaaaccuuugaaaaacuagagaaaauaguagcugaauauccagaaucaauugaaguuguacaagauaauggaaaaguagauguccagaaaauaucaccauuugaauuauacaggaaagacaauggguuuguaacuaaauuugcaaagaaaaacaacggccccgcuguuaaaucguuaaaauacuacgauagcaaacuaggaagcucuauagauguaacuccagauaaugcuaaaaauaagaaaguaauccuacaaucauugaaaccauggcgaacagacgucuacuucaacgaagaaaaccaagaauacgaaauaaugggucuaaaauauucagaucuaaaauuugguaaaaacggaaaauacggaguaccaaaaguaagauaugaagaaauuaaacaagaagaagaaauaucagaagguuccaaauuucuauucucacuguaccgcggagacaggauaaaggucaccaacgaacuaggagaaaaccuugaucuauuguuuucaagcagaacgcuaccagcacaaaaaggguauguugaauuaaaaccaaucgauaaaacaaaguucgaugguaaagaaaaggucucauucuacgggacuguaaccccuaauggacaauucguaaagaaauucgcaaagaaaggauacaaaauucucaaacucaacacagaugaauuaggaaauacauauauagaaaacggagaaaaagagcccagcgacauacuugauauguga

SEQ ID NO: 5108 - RNA, 3366 nt, Artificial Sequence
  Cas9 variant
augaacggauuaguauuaggauuagacauaggaauaggaagcguaggcgucggcauucuaaacaaagacacaggagaaauuauccaugcgaacucaagaauuuucccugcugcuacagcagacaacaauguaguaagaagaucaagucgucagggacggagauuaaaccacagaaagaaacaucgaaguguacgacuaaaagauuuauuugaauauuaugaucuacugacagacuucuccaaagucaguauuaaccuaaauccauauagacuaagaguaaacggccuuaaucaacaauuaacgaaugaagaacuuuuuaucgcacucaaaaacauagucaaacgaaggggaaucucuuaucucgacgacgcaagcgaagauggaggagcaguuucgucagauuauggcaaagcaguagaagaaaacagaaaacuucucgcugagcaaacaccaggccaaauacaauuagagagauuugagaaauacggccagguucgaggcgauuucacaguagucgaaaauggagagaaaagaagacucauaaauguauucagcacaagugcauauaagaaagaagcagaaaggauauuaagaaaacaacaagaauacaauaaucaaauaauggacgaguucauagcagauuauuuaacuauacucaccggaaaaagaaaauauuaccacgguccaggaaacgaaaaauccaggacagauuauggacguuucaggacagauggaaccacauuagauaauauauuuggaauccugaucggaaaaugcacauucuacccagaaaaauacagagcaaguaaagcaucuuacaccgcacaagaguucaaccuacuaaacgaucuaaacaacuuaacgguacccaccgaaaccaagaaauuauccgaagaacaaaagaaaacuauagucgaauaugccaaauccgcaaaaacacucggugcaucaacucuucuuaaauacauagcaaaaaugauagaugccucaguugaucaaauacgaggcuacagaguagaugucaaaaacaaaccagaaaugcacaccuucgaaguauaccgaaaaaugcaaucacuagaaacaauaucaguaggggaauuuucaagagaaguauuagacgaacuagcacauguacucacacuaaacacagaaagagaaggaauagaagaagcaauaaauacaaaacucagagauagcuuuucgcaagaccaaauucuagagcuaguacaguuucggaaaaauaauucaagccuauuuucaaaaggauggcacaacuucagcuuaaaacuaaugauggaauuaauacccgaacuauacgaaacgucagaagaacaaauggcuauacuaacaagacuaggaaaacagaaauucaaagaaacaucaaaaaggaccaaauauauagacgaacaagaaguaacagaagaaaucuauaacccgguaguggcgaaaucugucagacaagccauuaaaauaaucaaugaagcaacaaagaaauacggaauauucgacaauauagugauagaaauggccagagaaaauaacgaagaagaagcaaagaaagacuauauaaaacgacaaaaagcgaaccacgacgagaaaaaugcagccauggaaaaagcagcauuucaauacaacggugaaaaagaacuaccggauaguauauuucacggacauaaagaacuagcgaccaaaguacgacuuuggcaucaacaaggcgaaaaaugccuauauacaggcaaaaauaucccuauaagcgaccuaauacacaaucaguauaaauacgaaaucgaucauaucuugccacuaucucuuuccuucgacgauucacuaucaaauaaaguccuuguucuagcaacagcaaaccaagaaaaaggacaaagaacaccauuucaagcacuagacucaauggaugaugcuuggucauaccgcgaguucaaaucuuacguuaaagacaguaaaucccucggaaauaaaaagaaagacuauuuauuaacagaagaagacauauccaaaauagaagugaaacaaaaauuuauugaaagaaaccuaguugacacaagguacagcucacgaguaguacuaaauacucuucaagacuucuacaaagcacacaaauucgacaccacaauaucaguaguacgaggacaauuuacgagccagcuuagaaggaaauggggacuagaaaaaucuagagaaacuuaccaucaccacgcaguugacgcacuaaucauagcagcgaguagucaauuacgacuauggaagaaacaaaacaauccucuaauaucauauaaagaaggccaauuuguagacucagaaacgggagaaaucauaucacuaaccgacgacgaauauaaagaacucguauucaaagcucccuacgaccauuucguagacacacucagaucaaagaaauuugaagacucaauccuguuuucguaccaaguagacucaaaauuuaaccgaaaaauaucagacgcaacaauuuaugcaacccgcaaaacaaaacuugacaaagacaaaucugaagaaacuuauguacuuggaaagauaaaagacauauacagccaaucuggauacgaugcauuuauaaaaauauacaacaaagacaagucaaaauuccuuauguaccauaaagacccacagacauucgaaaaaguaauagaagagauccuaagaacuuaccccucaaaagaguucaaugagaaaaauaaggaaguaucaugcaauccauuugaaaaauauaaacaagaaaauggccccauaagaaaauacuccaagaaaggaaacggaccagaaauaaaaagccucaaauacuacgauaaaaauauccccgagagcuucauaaauaucacaccaucaaacuccaaaaacaaaguaaucuuaaggcaacucaacccauggcgaacugacguauacuucaaccaucaaacagaaaaauacgaacuauugggucuaaaauacgcugaucuacaguucgaaaagaaaacaggaacuuacuccauaacgauagacaaauauaacgaaauuaaagaaaaagaagguguaucagaacacagcgaauuuaaauucacccuauauaaaaaugaccuccuacugaucaaagacacagagauuaaggaggaacaaauuuuuagauuuuuaucgcgaaccaugccaaaucaaaaacauuacguagaacuaaaacccuauuauaaaggaaacuucgaaggaaaagaaagaauaaaagucuuuaacaccacaucaaacgguagaugccuuaaagguuuacgaaagaaaggccuaucuauauacaaaauaaaaacagauguacuaggcaacaaacacuucauaaagaaagaaggcgaaaaaccgaaauugaaauuuuga

SEQ ID NO: 5109 - RNA, 3366 nt, Artificial Sequence
  Cas9 variant
augagcgacuuaguacuaggacuugacauagguaucggaucuguaggaguuggcauacuuaacaaaguaaccggagaaauaauucacaaaaacucgcgaauauucccugcugcccaagcagaaaauaauuuaguacgccguacaaaccgacaaggucguagauuaacucgaagaaagaaacauaggauaguccgccuaaaucgccuguucgaagaaagcgggcuaauaaccgacuucacaaaaauuucaauuaacuuaaacccauaucaauuaaggguaaaaggccuuacugaugaacuaucaaacgaagaacuauuuauagcacuuaaaaacaugguaaaacacagaggaaucucauacuuagacgaugcaucugaugacggcaauucuuccguuggagacuaugcccaaauuguaaaagaaaacagcaaacaacuagaaaccaaaacaccaggucaaauacagcucgaaagauaccaaacauacggacaguugagaggagacuuuacaguagaaaaagacggaaagaaacauagacuaauaaacguuuuccccacaucggcguauagauccgaagcauuaagaauauuacaaacacaacaagaguucaauccacaaauaacagaugaguucaucaacagauauuuggaaauauuaacagguaaaagaaaauacuaucauggaccagguaacgaaaaaucacgaacagacuauggcagauauagaaccagcggagaaacccuagacaacauauuuggaauccucauaggaaaaugcaccuucuauccugacgaguuccgcgccgccaaagccaguuauacugcacaagaguucaaccuacuaaaugaccuaaacaacuuaacuguaccaaccgaaaccaagaaacuaucaaaagaacagaaaaaucaaauaaucaauuacgugaaaaaugaaaaagcaaugggacccgccaaacuauucaaauauauagcuaaacuccugaguugcgauguagccgauauaaaagaauauagaaucgacaaaucugguaaagccgaaauacauacuuucgaagcauaucgaaagaugaagacauuagaaacccuugauauugaacaaauggacagagaaacgcuagacaaguuagcauacguauuaacuuuaaacaccgaacgagaagguauacaagaagcauuagaacacgaauuugccgacggcucuuuuagucaaaaacaaguagaugagcuaguacaauucagaaaagcuaacaguaguauauuugggaaaggauggcacaauuucaguguuaaacuuaugauggaacuuauccccgaacuauacgaaaccucagaagaacaaaugacuauauuaacaagacuaggaaaacagaaaacaacaagcucauccaacaaaacaaaguauauagaugaaaaauuacuaacagaagaaauauauaaucccguaguggcaaaaucuguccgacaagcuauaaagauaguaaacgcugcaauaaaagaauacggugacuuugacaacauagucaucgaaauggcuagagaaaccaaugaagacgaugaaaagaaagccauacagaaaauacaaaaagcaaauaaagaugaaaaagaugcagcaaugcuaaaagcagccaaucaauacaauggaaaagcugaauuaccacacucagucuuccacggccauaaacaauuggcaacaaaaauaagacuauggcaccaacaaggcgaaagaugucuauacacgggaaaaacaauuaguauacaugaccugauaaacaauaguaaucaauucgaaguugaccauauccucccgcugucaauuacguucgaugauaguuuagccaacaagguauugguauaugcuacagccaaccaagaaaagggccaaagaacaccauaucaagcgcuagauagcauggacgacgcauggagcuucagagaacuaaaggcuuucguacgggaaucuaaaacacuaucaaauaaaaagaaagaauaucuauuaaccgaagaagacauaucaaaauucgacguaagaaagaaauuuauagaaagaaaucuaguggauacaagauacgcuagcagagucguccuaaaugcauuacaggaacacuuuagagcacacaaaauagacacaaaagucuccguaguuagaggacaauucacaagccaacuaaggagacacuggggcauagagaaaacaagagacacauaccaucaucacgccguagacgcauuaauaauugcugcaucaauacaacucaauuuguggaagaaacagaaaaauacccuagucuccuauagcgaagaccaacuauuagauauagaaacaggagaauuaauaucagacgaugaauacaaagaaaguguuuucaaagccccauaucaacacuucguagacacuuuaaaaucaaaagaguucgaagacucgauacuauuuucauaucaaguggacaguaaauucaaucgaaaaauaucagacgcaacgaucuacgcaacacgccaagcaaaaguggguaaagacaaagccgacgaaacuuacguauuaggaaaaauaaaagauauauacacucaagacggauaugaugcguuuaugaaaauuuacaagaaagauaaaucuaaauuccugauguaccgccaugacccgcaaacauucgaaaaaguaaucgaacccauauuagaaaauuauccaaauaaacaaauaaacgaaaaagggaaagaagucccagucaauccauucuuaaaauauaaagaggaacauggauauauacgaaaauacucaaagaaagguaacggaccagaaaucaaaucgcucaaauauuacgacuccaaacuuggaaaccauauagacauaacucccaaagauucuaacaacaaaguaguacuacaaucugucucaccauggcgagcagacgucuacuuuaacaaaacaacaggaaaauacgaaauacuuggacuuaaauacgcagaccuacaauucgaaaaaggaacaggaacauauaaaauaagccaagaaaaauacaaugacauuaaaaagaaagaaggaguagacucagauucugaauuuaaauucacacuauacaaaaacgacuugcuacucgucaaagacacagaaaccaaagaacaacaacuauuccgauuccuaucaagaacaaugccaaaacaaaaacauuacguagaauuaaaaccguacgacaaacaaaaauucgaagggggagaggcacuaaucaaaguucuagguaaugucgccaauucuggacaaugcaagaaaggacucggaaaaagcaacauuagcauauacaaaguccguacagauguauuagguaaucaacacauaauuaaaaaugaaggagauaaaccaaaauuagacuuuuga

SEQ ID NO: 5110 - RNA, 3366 nt, Artificial Sequence
  Cas9 variant
augaacggucuagucuuaggacucgacauaggaauagccaguguaggagucggaauauuagagaaaaauagcggaaaaauaauacacgcaaauucucgccucuucccagcagcaacagcagacaauaacguagaacgucggaaaaacagacaagcuagaagauuaaaccgaagaaagaaacauaggggaguccgauuccaagaccuauucgaagacuauggucuacuaacagacuuuucaaaagugagcauaaacuuaaauccguauagguuaagaguagacggccuaaaucaacaauuaacaaacgaagaacuauucaucgcucugaaaaauauugucaaacguaggggaauaaguuauuuagaugaugcauccgaagacggaggcgccguaucaucagauuacgguaaagcuguagaagaaaaucgaaaacuacucgcagaacaaaccccaggacaaauacaacuagaaagauucgaaaaauauggccaaguaaggggagauuuuacaguaguagaaaauggagaaaaaugccgccuuaucaaugucuucaguacuucugcuuaccgaaaagaggcagagaaaauacuuaggaaacaacaagaguucaacaaccaaauaaccgacgaauuuauugaagauuaccuaaaaauauuaacuggcaaacguaaauacuaucauggaccaggaaacgaaaaaucaaggacagauuacggaagauuucggacagauggaacaacccucgacaacauauucggcguacuaauagguaaauguacauuuuauccaaaugaauacagagccagcaaaucgucauacaccgcccaagaguucaaccuacuuaaugaccucaauaaucucaccguaccaacggaaacaaagaaauuaagugaagaacaaaagaaaguaauaguugaauacgcuaaagaagccaaaacauuaggagcgucaacacuguuaaaauacauaguuaaaaugauagacgcuucugucgaucaaauuucuggauauaggguagauguaaacaacaaacccgaaaugcacaccuucgaagucuauaggaaaaugcaaucucuagaaacuaucagcguaggagaauuaucaagaaacguauuagacgaacuagcacauauacuaacacuaaauacagaaagggaaggcaucgaagaagcaauaaauucuaaauuaaugggaguauuuagccaagaccaaguuuuagaauuaguacaauuccgcaaaaacaacucaucacucuuuagcaaagguuggcauaacuucagccuaaaauuaaugauggaauuaauaccugaacuuuacgaaacaucagaagaacaaaugaccauacuaacuagacuaggcaaacaaaagaguaaagaaacaaguaaaagaacaaaauacauagaugaaaaagaauuaaccgaagaaauauauaacccgguaguugcuaaaagugucagacaagcaaucaaaaucauaaacgaagcaacuaagaaacacggaauauuugauaacauagucauagaaauggcgagagaaaacaacgaagaagacgcaaagaaagacuacauaaaacgacaaaaagcaaaccaagacgagaaaaacgcggcgauggaaaaagcagcauuccaauauaacggcaagaaagaacuaccaggcaacauauuuaacggccacaaagaacuagcuacaaaaauacgcuuguggcaucaacaaggggaaaaauguuuguacacaggaaaaacaauaccaauaagcgacuuaauccacaaccaauacaaauaugaaaucgaccacauccuaccccuuucacuuagcuuugacgacucauuaucaaauaaagucuuaguucaugcaacagcaaaucaagaaaaaggacaaagaacuccauuucaagcacuagacucaauggacgacgccuggagcuacagagaauuuaaaaguuauguaaaagacuuaaaaucguuauccaacaaaaagaaagauuaccuacuuaccgaggaagacaucucaaaaaucgaaguaaaacaaaaauuuauagaaagaaaucuaguugauacaagauacagcucuagaguugugcugaacgcucuacaagacuucuacaaaagccaccaauucgacacaaccauaagcgucguaaggggccaauuuacaucacaacucagaagaaaauggggacuggagaaaaguagggaaacauaucaucaucacgcuguugaugcauuaaucaucgcagcauccucacaacugagguuauggaagaaacaaaauaaucccuuaauaacauacaaagaaggccaauuugucgauucccaaacaggagaaauuauuagcuuaacagacgaugaauacaaagaacucguauuuaaagcaccuuaugaccauuucguagacacacuacacucuaaaacauuugaagauggaauauuauuuagcuaccaaguagacucaaaauacaacagaaaaaucucggacgcuacaaucuacgcaacaagaaaagccaaacuagacaaagauaaaagugaagaaacuuacguacuaggaaaaauaaaagacauauacucccaagcuggauacgaugccuuuauaaaaauauacaacaaagacaaaagaaaauuccuuauguaccauaaagacccacaaacuuucgaaaaaguuaucgaagaaaucuuaagaacauauccaucaaaagagagaaacgauaaaaauaaagaagugcccuguaauccauuugaaaaauaucgucaagaaaacggccccaucagaaaauacucaaagaaaggaaaugggcccgaaauaaaaugccuaaaauauuaugacaacaaacucggcaauuacaucgauauaucaccagacggaucugauaaccaaguaguccuacaaucacucaaacccuggaggaccgacgucuacuuuaaccaucaaacaaaagaauacgagcugaugggccuuaaguauucugauuuaaguuucgaaaaagggagcggcaaauacagcauuagcaaugaaaaauacaauagcauaaaaaggauagagggggucaaugaacaaucugaauuuaaauuuacucuauacaaaaacgaucuaaucuuaauaaaagauuccgaaaacaacgaacaaaagcuauucagauucaacucgagaaaugacacugcuaaacacuacguagaacugaaaccguacgauaaagcaagauucgauggacaacaagaacuaauaacaauccucgguaacguggcaaaaggaggucaauguuuaaaaggauuaaacaaaucaaacauaucuauuuuuaaaguaaagacggauguauuaggaaagaaacacaucaucaagaaagagggggacgaacccaaacuuaaauucuga

SEQ ID NO: 5111 - RNA, 3366 nt, Artificial Sequence
  Cas9 variant
auggcagauaaaaccuuaggagcacuaacauucggauuugauauagguauagcaucagucggcugguguguguuaggagaaaacagaaucguugaccucggaguucgagcuuuugauaaagcugaaacggcaaaagaaggugaaagccucaaucucgcuagaagaaccgcacgccuuaugagacgcagacucagaagacgagcauggagacuaacgaaacuagcacgacuacuuaaaagagaaggauuaauugcagaugcauuccaaaugcaucaaccaagugcgacaucuccguggaaguuaagaguagaagcgcuggaccgccgccucacagacgacgaaugggcaagaguuauauaucaucucuguaaacaccgugguuuucacuggauaagucgugcagaagaaaagaaagcagaaggagaugcaaaaggugaaucaggucguguaaagaaaggauugagugauacacaaagacgaaugggagaaaaaggauaucgguccgcagcugaaaugguacuugcugaauuuccugaagcucaaaggaacaaacaaggagauuauggcaaagcauuaagcagaguacuauuaagugaagaauuagcauuauuguuuagaagacaaagagaacuaggucacacucaugcaucuaaagaacuagaagcagcgaucuuaggaaauggagaucgaaaaggagguuuguuuugggcucaaaaaccuccacuagcaggagcagaucuuuuaaaaaugcuuggcaaauguacuuucgaaaaagacgaauacagagcaccaaaagcaucuuuuaccgcagaaagacacguaugguugaccaggcucaauaauuuaagagucguaguagaugguaccacgagaccauugacagaagacgaaagacggguagcacuaccauuaccauauggcuaugcggacgcuaaauuaacauauaaacaauuaagagcugcauuaagcaaagcugguuuaaguaauuuuaguuucgcgggaauugcugaugacaaagaaaaagauacgcuaacaaaauuaccagcaugggaaacgcuauccaaaacacuaaaaggaaaaggcuuagaaacugaaugggaaggaauggcgggugcagcuacgggaggagacccgacuuuacuugaugaaauaagcagaguacucucaguauauaaagauggcgacgaaguggacguugaauuaagaaaauuaccucuacccggaggagagaaaaugguugaaacauuaagcgaaauuagcuuugacaaauuucacgcauuaucguuaaaagcacuacgaaaaauaguaccacauauggaaacuggacucagguaugaugaagccugcgcagcggcaggcuaucaucauagccaacuccaugaagcaggcgcggguggacaaaaauauuuaccaccuuucuauacacgacgggauaaagacgggagaaugguauucgacgaggaacuagacguaccuagaaacccaguaguauuaagagcauugaaccaagcaagaaagguauugaacgcccuaguaagagcauauggcucuccaucagcagugcacauagaaauggcaagggauuuaaguaaaccgcuagugggacauccuaccccgaauggaggcuauauagaagguagaagagauauagaaaaacuccagaaagaauauagagaaagaaaugaaaaagauaaagccgcauucgcagcagaacaugguauagcagcaaaaucaagagaguucgaaaaguuucaacuuuauagagaacaacaaggcaaaugugccuauaguuugaaaccccuggaccuacaucgaguauuacaugacauagguuaugcugaaguugaccacgccuuacccuauucacgcucauacgacgaugggaaaaauaacaaaguacuugucuugacagaagaaaauagaaacaaagggaaucggacagcauacgaauaucuaugugcuuuuccagguggggaaaauggagagagauggagaaauuucgucgcauauguagaaaguaacaaaaguuaccgacuagccaaaagaacaagauuauuaagaaaagacuucggaggaaaagccgcagaggaauuucgagaaagaaacuuaaaugauacgagauauauauguaaauucuuuaaaaauuuuguagagagguuuuuacaacuaaaggugggagcagauggaacagcagcaaaaagaugcguaguacucucaggacaaacaacagcauuuuuaagagcuagguggggucuauuaaaagucaggggugcuagugaucgacaucaugcacuugaugcagccguaguugccgcuuguucacauggaaugguaaaaagauuagcagacuacagcagaacuaaggaacucgcaaaaguacgagauggauucccggauccagaaaccggagaaauaguagacccagcgauguuucaacaacuacaugcacacuuuccugacccauggccccauuucagaggggaacuagaagcacgacuacagcuagaugauucggcagaauugcgcgcacaacuugaaauguuuggaacauauccagcggaagcacuagaaacauuaagaccacuauuuguuucacgugcaccacaaagaagaaauggcggagcagcacacaaagaaacuauauacgcacaaccugaacgccucaaggaacaaggagggguaacacaaaaaguaucccuagccucccuaaaaccaacagauauugauaaauugaucgauccacaccgaaacgaaaaauuguacgcggcaauacgcgcgagacuagaagcucaugguggaaaaucagauaaagcauucccugcugauaauccacuacgaaaaccggacagagaugguaauccuaccgguccaauaguccgcgcuguaacaaugguaauagacaagcugucggguauacaaauuagaggaggaauugcaaagaaugacacgaugcuacgaguugacguauuucgacacaagaaagauggcaaauuucauuuaguaccacucuacguacaccacgcuguggcucaagaauuaccgaauagagcuauaguagcuuucaaagaugaagaugaauggacacuaauagaugauaacuuucacuuuuuauuuuccuuucauccaaaugacuucauaagaaucacacagaaaaacaaagcaccuauauuaggauauuaugcaucaugucaccgaggaacuggcaaucuaaaucuaugggcacaugaucgaaaucaaaaaguagguaaagauggacaaauugaaggaauugggguaaagaccgcgguagcucuagagaaauuucacguagacguguuaggaaauauauauccagcgcccccagaacaacgacacggacuagcauga

SEQ ID NO: 5112 - RNA, 3366 nt, Artificial Sequence
  Cas9 variant
augucagauuuaguauuaggauuagacauaggaauaggaucuguagguguaggcauauuaaauaaaguuacuggagagauaauacauaaaaauagcaggauauuuccagccgcacaagcagaaaauaaccuuguucggagaacaaaccgacaaggaagaaggcuuacuagacguaagaaacaccgcagggucaggcuaaaccgcuuguucgaagaaagcggacuaauaaccgauuucacaaaaauaucaauuaaucuaaauccauaucaacuacgagugaaagguuuaacagaugagcuaucaaaugaagaacucuucauagcccuaaagaacauggucaaacaccgcgguauauccuaucuagacgacgcgagugacgacggaaacucaucaguaggcgauuacgcacaaauagugaaagaaaauuccaaacaacucgaaacaaagaccccaggccaaauacaacuagaacguuaucaaacuuacggacaauuacgaggugauuuuacagucgaaaaagaugguaagaaacaucggcuuauuaauguauucccaacaagugccuaucgaucagaagcauuacgaauccuacaaacacaacaagaauuuaauccacaaauaacugaugaguucauaaauagguauuuggaaauacuaacaggcaaacgaaaauauuaccacggcccugguaacgagaaaagucgaacagacuacggaagauacagaacaaguggagaaacucuagauaacauauucggaauauuaauaggaaaaugcacuuucuauccagacgaguucagagcagcaaaggcuucauauaccgcccaagaguucaauuuacuaaacgacuuaaacaacuuaacaguaccgacagaaacaaagaaacucaguaaagaacagaaaaaccaaauaaucaauuacguuaaaaaugaaaaagcaaugggaccagcaaaauuauucaaauacauagcuaaacucuuaucaugcgacguagcugacauaaaaggcuauagaaucgauaaaaguggcaaggccgaaauucacaccuucgaagcauauagaaagaugaaaacacucgaaaccuuggacauagaacaaauggauagggaaacacuagauaaacuugcauauguauuaacacuaaacaccgaaagggaaggaauacaagaagcacuagaacacgaauuugcggauggaucauucucacaaaaacaaguagacgaacucguacaauuccgaaaagcaaacucaagcauauucgguaaaggauggcauaauuucucaguaaaacugaugauggaacuaauaccagaacuauacgaaaccucggaagaacaaaugacgauacuaacaagguuaggcaaacagaaaacgacaucaucaucaaauaaaacuaaauacauagaugaaaaacuauuaacagaagaaauauacaacccagucguagccaaaaguguccgacaagcuauaaaaauuguuaacgcagcuauaaaagaauauggcgacuucgauaauauaguaaucgaaauggcacgagaaacaaaugaagacgacgaaaagaaagcgauacagaaaauccaaaaagcaaacaaagacgaaaaagaugcugcaaugcuaaaagcggcuaaucaauauaacgguaaagcugaauuaccccacucaguauuccacggccauaaacaacuggcuacaaaaauuagacucuggcaccaacaaggagaacgaugucuauauacaggaaaaaccaucucaauucacgaucucauaaacaauagcaaucaauucgaaguagaucauauucuaccucucucuaucaccuuugaugacucccuagcaaacaaaguacucguauacgccacagcaaaccaagaaaaaggacaaagaacacccuaccaagcacuagacucaauggacgacgcauggaguuuucgugaacuuaaggcauuuguaagagaaagcaagacauuaucuaacaaaaagaaagaauaccucuugaccgaagaagacauaucaaaauucgaugucagaaagaaauuuaucgaacgaaaucuugucgacacgcgauaugcuucaagaguaguacucaacgccuuacaagagcauuuuagagcacauaaaauugauacuaaaguaucaguaguccgaggacaauuuacaagccaauuacgucgacauuggggaauagagaaaaccagagacacauaccaccaucacgcuguggacgccuuaauaauugccgcaucgagccaauuaaacuuauggaagaaacagaaaaacacacucgucagcuacucugaagaucaacuacuagacaucgaaacaggcgaacuaauauccgaugaugaauacaaagaaucaguauucaaagcgcccuaccaacacuuuguagauacauuaaaaucaaaagaauuugaagacaguauucuauucucauaucaaguagauagcaaauuuaacagaaaaaucucagaugcaaccauauacgcaacaagacaagccaaaguaggaaaagacaaagcugaugagacauacguacuaggaaaaaucaaagacauauauacacaagacggauacgaugcauucaugaaaauauauaagaaagauaaaucaaaauucuuaauguaucgacacgauccacaaaccuuugaaaaaguaauagaacccauccuagaaaauuauccaaauaaacaaauaaaugaaaaagggaaagaaguacccuguaacccauuuuuaaaauacaaagaagaacauggcuacauacgaaaauacucgaagaaaggaaacggacccgagaucaaaagccuaaaauauuacgacagcaaacucggcaaucacauagauaucacccccaaagacuccaacaacaaaguaguacuacaaaguguaucuccauggcgagccgaugucuacuuuaauaaaaccacaggaaaauaugaaauacuaggccuaaaauacgccgaucuacaauuugaaaaaggaacuggaacauauaaaauuagucaagaaaaauauaacgauauuaaaaagaaagagggagucgacagugacagcgaauuuaaauucacucuauauaaaaacgaucuacuauuaguaaaagauacggaaacgaaagaacaacaacucuuccgauuucuaagcagaacaaugccaaaacaaaaacacuacguagaacucaaaccauacgacaaacaaaaauucgaaggaggugaagcacugauaaaaguauuagguaauguagcaaacagcggacaauguaaaaagggcuuagguaaaucaaacauaucgauauauaaagugagaacagauguacuaggaaaucaacauauaaucaaaaacgagggcgauaaaccuaaacucgacuucuga

SEQ ID NO: 5113 - RNA, 3366 nt, Artificial Sequence
  Cas9 variant
augaauggucuaguauuaggacucgacauuggaaucggaucaguuggaguaggaauacuaaauaaagauacaggcgaaauaauucaugcaaacucaagaauauucccagcagcuaccgcagauaacaacguuguaagacguucuucccgacaagggagacgauuaaaccaucgaaagaaacaucgauccgugcgacuaaaagauuuauucgaauauuaugaccuacuuacggauuucaguaaaguaaguauuaaccuaaaucccuaccgccuccgcguagauggauuaaaucaacaauuaacaaaugaagaauuauuuauagcacucaaaaacaucguuaaaagaaggggcaucagcuauuuagaugaugccagugaagacgggggcgcaguauccucagacuaugggaaagcagucgaagaaaaucgaaaauuacucgcugaacagacuccaggacaaauucaauuagaacgauucgaaaaauacggucaagucaggggagauuuuacagucguagaaaauggagagaaaaggcgauuaaucaaugucuuuucaacaucagcauauaagaaagaagccgaaagaauccuuagaaaacaacaagaauacaauaaccaaauaauggaugaauuuauagcagacuaccuuacaauacuaacaggaaaaagaaaauacuaucacggcccgggaaacgaaaaaucaaggacagacuacggucgauucagaaccgaugguacuacacuagauaacaucuucgguauccucauagggaaaugcacauuuuauccagaagaauaucgcgcaagcaaagcaucauauacagcacaagaauuuaaccuauuaaacgaucuaaauaaucuuacagucccuacugaaaccaagaaauugucagaagaacaaaagaaaacaauagucgaauacgcaaaaucugcaaaaacacucggagcaagcacccuacuaaaauacauagcuaaaaugauagacgcauccguagaccaaauaagagguuauaggguagauguuaacaacaaaccugaaaugcacacuuuugaaguauauagaaaaaugcaacuauuagaaaccauaccagugggcgaauuuucaagggaaguccuagacgaauuagcacacauauuaacccucaacaccgaacgagaagguauagaagaagcaauaaacaccaaacuaauggacgucuuuucacaagaccaaauccuagaauuaguacaauuccguaaaaauaauaguucguuguucagcaaaggcuggcacaacuucucacuaaaacuuaugauagaacuaauaccagaacuauacgaaacauccgaagaacaaauggccauauuaacaagacucgguaaacaaaaauucaaagaaaccuccaaaagaacaaaauauauagacgaacaggaaguaacagaagaaaucuacaaccccguuguggccaaaucuguaagacaggccauaaaaaucauuaaugaagccacaaagaaauacggaauauuugauaacauuguaauagaaauggcaagagaaaauaacgaagaagaagcuaagaaagacuacauaaaaagacaaaaagcaaaucacgaugagaaaaacgccgcaauggaaaaagcugcauuccaauauaauggagaaaaagaacuaccugacuccaucuuucauggacacaaagaauuggcgacaaaaguaagacucuggcaccaacaaggagaaaaaugccuauauacggggaaaaacaucccaaucucagaucuaauucauaaccaauacaaauacgaaauagaucacauacucccccuaagucuuagcuuugacgacagucuaucaaacaaaguuuuaguccuagcuacagcuaaucaagaaaaaggacgccgaacacccuuucaagcacuugauuccauggaugacgcuuggucuuaucgggaauuuaaaaguuaugugaaagacagcaaaucguuaggaaacaaaaagaaagauuaccuguuaaccgaagaagacaucucaaaaauagaaguaaaacaaaaauuuauagaacggaauuuaguagacacccgcuacucaucaagaguaguacuaaacacacuucaagacuucuacaaagcacacaaauucgacaccacaaucagcguuguucguggacaauucaccucacaacucagacguaaauggggcuuagaaaaaucgcgggaaacuuaccaucaccacgcggucgaugcucuaaucaucgccgcaagcucccagcuaagacuauggaagaaacaaaauaaucccuuaauaucauacaaagaaggacaauuuguagacucagaaacaggagagauaauaaguuuaacggaugacgaauauaaagagcuagucuucaaagcaccauacgaucauuuuguggacacacucagaucgaagaaauucgaagauucaauucuauuuagcuaucaaguggauaguaaauuuaacagaaaaauaagugaugcaaccauauacgcaacuagaaaagcgaaacuagauaaagacaaauccgaagaaacauacguacucggaaaaauaaaagauauauacucccaguccgguuacgaugccuuuauuaaaauauauaauaaagauaaauccaaauuucugauguaucauaaagacccacaaaccuucgaaaaaguuauugaagaaauacuacgaaccuacccaucaaaagaguucaaugagaaaaauaaagaagucaguugcaaccccuucgaaaaauauaaacaagaaaacggaccaauacgaaaauauagcaagaaaggaaacggccccgaaauaaaaagucuaaaauacuacgacaaaaauauaccagaaucauuuauuaauaucaccccauccaacuccaaaaacaaaguaaucuuaagacaauuaaacccuuggcgaaccgauguauauuucaaccaucaaacagaaaaauacgaauuacuuggguuaaaauaugcagaucuccaauucgaaaagaaaacaggaaccuacucgauuacuauagacaaauauaacgaaauaaaagaaaaagaaggaguaucagaacacucagaguucaaauucacacuauauaaaaacgauuuacuuuuaauuaaagauacagaaauaaaagaagaacaaauauucagauuccuaucaagaaccaugccuaaccaaaaacacuacguagaacuaaaaccauauuacaaaggaaauuuugaaggcaaagaaagaaucaaaguauucaauacaaccucaaauggacgaugcuuaaaaggacuacgaaagaaaggacuaaguauauacaaaauuaaaacagacguucucgguaauaaacauuuuauaaagaaagaaggcgaaaaacccaaacuaaaauuuuga

SEQ ID NO: 5114 - RNA, 3369 nt, Artificial Sequence
  Cas9 variant
augaacgggaaaauacuaggauuagauaucgguguggcaucaguagguguuggaauauuagauaagaaaacgggugaaauuauacacgcaucaucgagaauauuucccgccgcuacagcagauuccaauguagaacgaagaggauucagacaaggacgucgauugggcagaagaaagaaacaccgcaaaguuaggcucgcagacuuauucucagacacaggacuaauaacagauuucucaaaagugaguauaaauuuaaauccuuaugaauuacguauaaaaggccucaaugaaaaacuaacaaaugaagaacucuuuauagcccugaaaaauauagugaaaaggaggggaauuucguaccuagaugacgcuaacgaagacggggaaucaagcucaucagaauauggaaaagcugucgaagaaaaccgaaaacuacuagcugacaaaacuccaggucaaauacaacuagaacgauucgaaaaauauggacaaguuaggggagauuuuacaauagaagaaaacggagagaaacacagacuauuaaacgucuucucaaccucugcauauaagaaagaagcagaaagaauauuaacuaaacaacaagauuacaaucaagacauuacagacgaauuuauacaagcauacuuaacgauauuaacuggaaaaaggaaguauuaccacggaccgggcaacgaaaaaucccgaacugauuacgguagauucagaacagauggcacuacucuagacaacauauuugggauacuaaucggaaaaugcacauuuuacccagaagaguacagagcggcgaaggcuaguuauacggcacaagaguucaaucugcuaaacgacuuaaauaaucuaacaguaccuacagaaacaaagaaauuaagcgaagaacagaaaagacaaauaauugaauaugcuaaaggagcaaaaacauuaggcgcagcaacgcuacuaaaauauauagcaaaauuaguagacggaagcguagaagauauaaaaggcuaucgaauagauaaaagugaaaaaccagaaaugcacacauuugacauuuacaggaagaugcaaacucuagagacaguggacguagaaaaacuaucaagagaaguacuugacgaacuagcgcauauauuaacccuaaauacagaaagagagggaauagaagaagcaaucaaaguaucauucauaaaaagagaguuugaacaagaccaaauagcugaauugguaucauuccgaaaauccaacucauccuuguuuggaaaaggauggcacaacuucagcauaaaacuaaugaccgaacuaauccccgagcuauaugaaacaucggaagaacaaaugaccauauuaacaagacuaggcaaacagaaaacuaaagcaagguccaaacguacuaaauauaucgaugaaaaagagcuaacagaugaaauauacaacccaguuguagcaaaaaguguacgacaagccauaaaaauaauuaaccuagccacgaagaaauacggcguauucgauaacaucguuaucgaaauggccagagaaaacaacgaagaagaugcaaagaaagacuauguaaaacgacaaaaagcuaacgaagaugagaaaaacgcggcuauggaaaaagcagcgcaccaauacaacggaaagaaagaauugccagacaaugucuuucacggacauaaagaacuggcaaccaaaauaagauuauggcaccaacaaggcgaaaaaugucucuacacagguaaaaacauaccaauauccgauuuaauacauaaucaauauaaauacgaaauagaucauauauuaccucuaucacucagcuuugaugauucacuagcaaauaaaguucuaguauuagccaccgcuaaccaagaaaaaggacaacgcacacccuuccaagcgcuagacucaauggacgacgcauggucauacagagaguucaaggcuuacguucgcggagcacgcgcccuaaguaacaaaaagaaagauuaucuauuaaaugaagaagauauaaacaaaauagaaguaaaacaaaaauucauagaacgcaacuuaguugacacacgcuacucgagcaggguaguacuuaaugcauuacaagacuucuacaaacuaaaugacuuugauacaaaaauaucugugguccgcggacaauuuaccucacaacuaagaagaaaauggcgaaucgacaaaucaagagaaacuuaucaccaucacgcaguugacgcauuaaucauagcugcaucuucacaacuaagauuauggaagaaacaaggcaacccacucauauccuacaaagaaaaucaauuugucgauagcgaaacaggagaaauaauaucacuuacagacgacgaauauaaagaacucguauuccgugcaccguacgaucacuuugucgauacaguaucauccaagaaauuugaagacagaauacuauucuccuaucaagucgacagcaaauauaacagaaaaaucagugaugcaacaauauacucaacuagaaaagcgaaacuaggaaaagauaaaucagaagaaacauacguacuaggaaaaauuaaagauauauauacacaaacugguuaugacgccuucauuaaacuauacaagaaagauaaauccaaauuucuaauguaccauaaagauccaauaacauuugaaaaaguaauugaagaaaucuuaaaaacuuacccagacaaagaaauuaacgaaaaaggcaaagaaguagcuuguaacccauuugaaaaauauagacaagaaaacgguccgcuacguaaauacucgaagaaaggaaaaggucccgaaauaaaaucccuaaaauacuacgacaacaaauuagguaaucauauagacaucacaccagacaacagcgaaaaccaaguuauacugcaaucacuuaaaccuuggagaacagacguauacuuuaaccauaaaacaaaaauauacgaauuaaugggccucaaauacucugaccuaucauuugaaaaaggcucaggaaaauauagaauaucacuagauaaauauaacguaauuaaaaagaaagaaggcguacacaaagaaagugaguuuaaauucacacucuauaaaaaugauuugauacuaauuaaagacuuagagaaaagcgaacaacaacucuuucgauauaacagucgaaaugacacaucaaaacacuauguagaauuaaaaccauaugacaaagcaaaauuugaaggaaaccaaccauuaauggcgcuauuuggaaaugucgcaaaaggaggacaaugucuaaaaggucucaacaaagcuaauauaaguauauacaaaguacaaacagaugucuuaggcaacaagagauuuauuaagaaagaaggugacgcaccuaaacuggaguucuga

SEQ ID NO: 5115 - RNA, 3369 nt, Artificial Sequence
  Cas9 variant
augagugacuuaguacuuggauuagacauaggaauuggcaguguagggguaggaauauuaaauaaaguuacaggagaaauaauccauaaaaacagucgaaucuucccugcagcacaagcagaaaacaaccuaguaagaagaacaaacagacaaggaagaagauuaacgaggaggaagaaacauagaaucguaagacucaauaggcuauuugaagaaucuggauuaauaacugauuuuacaaaaauaucaauuaaucuuaacccauaucaauuacgagucaaaggauuaaccgacgaacugucaaaugaagaacuauucaucgcccugaaaaacauggucaaacacagaggcauaucauaccuagacgaugccagugacgacgguaauucgagcgugggcgacuaugcucaaauagucaaagaaaacucaaaacaacuagaaacaaaaacaccaggacaaauacaacucgaaagauaucaaaccuacggacaacuaagaggagauuuuaccgucgaaaaagacggaaagaaacacagacuaauaaauguuuucccaaccucagcauacagaucagaggcuuuaagaauauuacaaacucaacaggaguucaacucacaaauuacagaugaguucauaaaccgauaucuagaaauauuaaccggaaaaaggaaauacuaccaugguccagggaaugagaaaagccgaacagacuacggacgcuauaggacgaacggagaaacacuugacaauauauucggaauacuuauaggaaaaugcacauuuuaucccgaugaguucagagcugcuaaagcaucauacacagcacaagaauuuaacuuauuaaacgaccucaacaaucugacuguaccgacggaaacuaagaaacucucaaaagaacagaaaaaucaaauaauaaauuaugucaaaaaugaaaaaguaaugggaccugcaaaauuauucaaauauaucgcaaaacuauuaucaugugauguagcagacauaaaaggacacagaaucgacaaaagugguaaagccgaaauucacacauucgaagcguacagaaaaaugaaaacacuagaaacauuagauaucgaacaaauggauagagaaacuuuggauaaacuagcauacguuuuaacucugaacaccgaaagagaaggaauacaagaagcacuggaacacgaguucgcagacggcagcuucucacaaaaacaaguagacgaauuagugcaauucaggaaagcaaauucaucaauauuuggaaaaggauggcauaauuucaguguaaaacuuaugauggaauuaauuccagaacuauacgaaacaucggaagaacaaaugacaauauuaacaagguuaggaaaacagaaaacaacgagcucaagcaauaaaaccaaauauauagaugaaaaauuauuaacagaagaaauauacaaucccguaguagccaaaagcguacgacaagcuauaaaaauugugaaugcagcaauaaaagaauacggggacuucgauaacaucguuauagaaauggcccgagaaacaaacgaagaugaugaaaagaaagcuauacagaaaauacaaaaagcuaauaaagaugaaaaagaugccgcaaugcuaaaagcagccaaccaauauaaugguaaagcugaacuuccacauucaguuuuucauggacacaaacaacucgcaacaaaaauacgauuauggcaucaacaaggggaaagauguuuauacacaggaaaaacuauuuccauacacgaccuaauaaauaacccuaaccaauucgaagucgaccauauacuaccccuaucaauaacuuucgaugauagucuugcaaacaaaguacucguguacgcuaccgcuaaccaagaaaaaggccaaagaacaccauaccaagcccuagacagcauggacgaugcuuggucauucagagaacucaaagcauuuguacgagaaucuaaaacgcuaucaaacaaaaagaaagaauaccuuuuaacugaagaagacauaucaaaauuugacguaagaaagaaauuuauugaacggaaccuaguagacacacguuaugcuucuagaguaguauugaaugccuuacaagaacauuucagggcacauaaaauagauacaaaaguuucaguaguacguggacaauuuacaagucaacuccgaagacauuggggcauagagaaaacaagagauacauaccaucaucaugccguagaugcauuaauaaucgcagcaucgagccaauuaaaucucuggaagaaacagaaaaacacacuugucuccuacagugaagaacagcuccuugauauagaaacgggggaacucauaagcgacgacgaauauaaagaaaguguauucaaagcaccauaccaacauuucgucgauacuuuaaaaucaaaagaauuugaagauagcauacuauuuagcuaccaaguagauagcaaauucaacagaaaaauuuccgacgcaaccauauacgcaacacggcaggcaaaaguaggaaaagacaagaaagaugaaacuuauguucuuggaaaaauaaaagacaucuauacacaagacggcuaugaugcauuuaugaaaauauauaagaaagauaaaucaaaauuuuuaauguauagacaugauccucaaacuuuugaaaaaguaauagaaccaauacuugagaacuacccaaacaaagaaaugaaugaaaaaggaaaagaaguucccugcaauccguuccucaaauauaaggaggagcacggauacauaagaaaauauucaaagaaaggaaacggaccugaaauaaaaagucuaaaauacuacgacagcaaauuacuaggaaacccaauagauauaacuccagagaacuccaaaaacaaaguaguacuacaaagucuaaagccauggcgaacagaugucuacuucaauaaaaacacaggaaaauacgagaucuuaggauuaaaguacgcagauuuacaauuugagaagaaaacagggacauacaaaauaucacaagaaaaguauaacggaaucaugaaggaagaagguguagacagugauucagaguucaaguucacacuauauaaaaacgaccuuuuacugguaaaagacacagaaacgaaagaacaacaacuauuuagauuuuuaucaagaacaaugcccaaugucaaauacuacguggaacuaaaaccauauucuaaagacaaguucgagaaaaaugaauccuuaauagagauauugggaucugcagacaagucgggaagaugcaucaaagggcuagguaaaagcaauauaucaauauauaaaguaagaacagacguauuggguaaccaacacauaaucaaaaaugagggagacaaaccaaaacuagacuuuuga

SEQ ID NO: 5116 - RNA, 3369 nt, Artificial Sequence
  Cas9 variant
augagcaauggaaaaauauuaggcuuagacauagguauagcaaguguaggcgucggaguaauagacgcacaaacaggagaaaucauacaugcaagcucaagaauuuuuccaucggcaaaugcagcgaauaacgccgagagaaggacauuuagaggaucacgaagacuaauucgacgaaagaaacaucgaauaaaaagauuagaugauuuauucaaugauuuccacauuaacuuagauggagaaaugaguacagacaacccauauguacuaagaguaaaagguuuaagucaaaaacuuacaguagaagaacuauacaucaguaucaaaaacauaaugaaaagacguggcauaaguuauuuagacgaugcagaaucagauaacgaagccggaagaagcgauuacgcaaaagcaauagaaagaaauagacaacugcuuacuucaaaaacuccuggagaaauccaacuugaaagacuugaaaaauauggccaauuaagaggaaacuuuacuauaauugacgaagaaggucaaagccaacaaauuauaaauguauuuagcacauccgauuaugucaaagaaguagagaaaauccuagauugucagaaaauguaucacaaauucauaucagacgaguucugugacaaauugauagaacuacucagagaaaaacguaaguacuacgucggcccaggcaacgaaaaaucaagaacagacuauggaauuuacagaacagauggcacgacauuagaaaaucucuuugguauacuuauaggcaaaugcacauuuuacccagaccaauacagaucaagcagagccagcuacacagcacaagaauuuaacuuuuuaaaugaccuaaauaaucuaacuguaccaaccgaaacuaagaaauuaagucaagaacaaaaagaguucuuagucaauuaugccaaagaaacaucgguacuaggggcaggaaaaauacugcaacaaauagcuaaacuagccgauugcaaaguagaagacauacgcggauaucgauuagacaacaaagacaaaccugaacuacauauuuuugaaacuuacagggcaaugaaagguuuaguuccauuaguagacaucggagugcuuucaagagaacagcuagacauuuuagcagauauacuaacuuuaaacacagauuucgaagguauaagagaagcauuaaagaaacaacuccccaacguuuuugaugaaaaacaaguaaaaggccucgcuagcuuucgcaaaaguaaaucgcaacuauuugcuaaaggguggcauaaccuaagccagaaaauuauguuagaaguaaucccagaauuauacgccacaucagaugaacaaaugacaauucuaacaagguuggguaaauucgaaaagaguucuguggcagaauauccaagcaguauaaauguagacgaaauaacagacgaaauauacaauccuguagucgcuaaaucgauaagacaaaccauaaaaaucauaaacgcaucaauaaagaaauggggagaauuugaccaaauaguuauagaaaugccacgagauagaaacgaagaugaagaaaagaaaagaaucgcagacggacaaaaagccaacgcgaaagaaaaagcagacucaauauuaagagcagcugaacuuuacugcgccgguaaaguacuuccugauuacgucuacaauggacauaaucaacucgccaccaaaauaagacuuugguaucaacaaggcgaaagaugcauauacacaggacaaccuauaagcauucaugaccuaauacauaaucagaaccaauacgaaauagaucacauauuaccauuaagccuaacauuugaugauucacuaaguaacaaaguacuuguccuagcaacagcaaaucaagaaaaagcacagcguacuccauauaauuacuuaaaaucagcaacaucugcauggaguuacagagaguucaaagauuacguaacaaaaaggaaagggauagguaaaaagaaaugugaauauuuaacuuuugaagaagauauuaauggcuuugaaguaagaaguaaauuuauucagcgaaaucucguugacaccagauacgcaagcaaaguuauauugaacgcguuacaagauuacuucaaaauaucaggaauacaaacaaaaguaucaguugucagagggcaguucacaagccaacucagacacaaauggggaauagagaaaacaagagaaacuuaucaccaucacgcaguagacgccuuaaucauugcugcaaguucccaacuaagacuuuggaagaaacaggaaagcccacucgugguagacuaucaagaaggacgucaaguggaccuagaaaccggugaaauccuagaacucacagaugaacaauacaaagagcuaguuuaucaaccaccuuaucaaggauuugugaacacaauaaguaguucagcauuugacaaugaaauucuauuuagcuaccaaguugacaguaaagucaauagaaaaauaagcgacgcuacuauuuacgcaacuagaaacgcacaauuaggaaaagacaaaacagaagguauuuacguucucggaaaaaucaaagacaucuacacacaagcuggcuacgaagcguuucucaaaagauauacaaaagauaaaacaucauuccuaauguaucacaaagaucucgauacaugggaaaaagucauugaaauaauucuaagagacuacagagaauaugaugaaaaaggaaaagaaauagggaacccauucgaaagguacagacgagaaaacggcuacguuaagaaauauucgcgcaaaggcaaugggacggcuauaaaaucauuaaaauauuacgauaacaaauuagggaaccacauagacauaacaccagaaaacucuagaaacgcaguaguauuacaaucuuuaaaaccauggcgaacagacguauauuucaacaaagaaacagguaaauaugaauuuuuaggcaucaaauacagcgaccucagcuuugaaaaaggaacuggggaauauggaauaucacaagaaaaauacgauucaauaaaaaucgcagaaggagucgcaaagaaaucaauuuuuaaauuuaccuuauauaaacaagaucuucuauucauuaaagacauagagaacaauuucggaaaacuauuaagauucacauccaaaaaugacacaucaaaacauuacguagaacuaaaaccauaugauaaaaauaaauuuggaacagaagaaccacuauuaccaguacuuggaaacguagcaaaaagcggacaaugcauaaaaggauuaaacaaaucaaacauauccauuuacaaaguacgaacagauauccucggguacagacauuuuauaaaacaagaaggagaacauccgcaacuaaaauuuaaaaaguga

SEQ ID NO: 5117 - RNA, 3369 nt, Artificial Sequence
  Cas9 variant
augaguaacgguaaaauauuaggccuagauauugguauagcaucaguaggcguaggcguuauagaugcacaaacaggagaaauuauucacgcaucuaguagaauauucccuagugccaacgcagcaaacaacgcagaaagacgaacauucagaggcucgaggcgccuaaucagaagaaagaaacaucguauuaaaagguuagacgaccuuuucaaugacuuccauauaaacuuagacggcgaaauguccacagauaacccauacguuuuacgcgugaagggauuaucacaaaaacuaacuguugaggaacuauacauuagcauuaagaacauaaugaaaagaagaggcauaagcuaucuugacgacgcagaaucagauaacgaagcaggaagaucggacuacgcaaaagcuauagaacgaaauaggcagcugcucaccucaaaaacgcccggagaaauacaauuagaacgacuugaaaaauacggacaacuucgaggaaacuucacgauaauugacgaggaaggacaaagccaacaaaucaucaauguauuuucaacauccgacuaugucaaagaaguagaaaagauucuagauugucagaaaauguaccauaaauuuauuagugaugaguucugugauaaacuaauugaacuacuccgcgaaaagagaaaauacuacguugggccaggaaacgaaaaaucaagaaccgauuaugguauauauagaacagacggaacgaccuuagaaaaucuauucgguauacuuauagggaaaugcacauucuacccagaccaauauagaaguaguagggccaguuacacggcacaagaauuuaauuuccuuaacgaccuaaacaaccuuacaguaccaacggaaacuaagaaauuaucccaagaacaaaaagaauuuuuaguaaauuacgcaaaagaaacgucuguucuaggagcgggaaaaauacuccaacaaaucgcaaaauuagcagauugcaaaguggaagauauccgaggauacagacucgauaauaaagacaaaccagaacuacacacauucgaaacauaucgcgccaugaaaggucuaguuccgcuuguagacauuggaguacuaaguagagaacaacuagauauacuagcagacauauuaacucuaaacacagauuucgaaggaauacgugaagcacuaaagaaacaauugcccaacguauucgacgaaaaacaaguaaaaggacuagcaucuuucagaaaaagcaaaucacaacuauucgcaaaaggauggcacaacuuaagucagaaaauuauguuggaagucauaccagaacucuacgcaacaagugaugaacaaaugacaauauuaacuagauuaggaaaauucgagaaaagcucaguugcagaauaccccaguucaauaaacgucgacgaaauaaccgacgaaauuuacaauccuguaguagccaagucuauacgacaaaccaucaaaaucauaaaugcuagcauaaagaaauggggcgaauuugaucaaauugucauagaaaugccacgugaucgaaacgaagacgaagaaaagaaacgaauagccgauggacaaaaagcaaacgcaaaagaaaaagcagauucaauacucagagcugccgaacuauacugcgccggaaaaguucuaccagacuacgucuacaaugggcauaaccaauuagcuacaaaaauacgacugugguaccaacaaggugaaagauguauauacacaggacaaccuauaagcauacacgaucuuauacauaaccaaaaccaauaugaaaucgaccauauacuaccucuauccuuaacuuucgacgacagucuaucaaauaaaguauuaguacuagcaacagcaaaucaagaaaaagcacaacgaacaccauacaauuaccucaaaucagcgacaagcgcuuggucauaucgcgaauuuaaagauuacguaacaaaacgaaaaggaauagguaaaaagaaaugugaauacuuaacuuucgaagaagauauuaacggauuugaaguacgaucgaaauucauacaaagaaacuuaguagacaccagauaugcaucaaaaguaaucuuaaaugcacuccaagauuacuuuaaaauaagcggcauucaaacaaaaguuucaguaguacguggacaauucacuagccaauuaaggcacaaauggggaauagaaaagaccagagaaacauaccaucaccacgcagucgacgcucuaauuauagcagcaucgucacaacuacgguuauggaagaaacaagaaagcccucuaguagucgacuaucaagagggaagacaaguugacuuagaaacuggagagauauuagaacuaaccgacgaacaauauaaagaacuuguauaucaaccgcccuaucaaggauuugugaauacaauaucaucuuccgccuucgacaaugaaauacucuucagcuaccaaguagauagcaaaguaaacagaaaaauuucggacgcaacaauuuacgcaacaagaaaugcacaacucggcaaagauaaaacagaaggaaucuacguuuuaggaaaaaucaaagacauuuauacacaagccgguuaugaggcauuccucaagagauacacaaaagauaagacauccuuucuuauguaccacaaagaccucgauacgugggaaaaaguaauagaaauaauacuacgagauuaccgagaauacgaugaaaaaggaaaagaaauaggaaaucccuucgaacgauacagaagagaaaauggauauguaaagaaauacucuagaaaaggaaacggaacagcaauaaaaagccucaaauauuaugauaacaaacuaggcaaccacaucgacauaacaccagaaaauagucguaacgcagucguacuacaaucucucaaaccauggagaacagauguauacuucaauaaagaaacaggaaaauacgaguuccucggcauuaaauauagcgaucuuuccuuugaaaagggaacaggagaauacggcauaucacaagaaaaauacgauucaauaaaaauagccgaagguguggcuaagaaaagcaucuucaaauucacccuuuauaaacaagaccuucuauucaucaaagacauagaaaacaacuucggcaaauuauuaagauucacaagcaaaaaugacacaaguaaacauuacguagagcucaaaccauaugauaaaaauaaauucgggacugaggaacccuuacugccaguguuagguaacgucgccaaaaguggacaauguauaaaaggauuaaauaaaagcaacauaucuaucuauaaaguuagaacugacauacuaggauaccgccacuuuauaaaacaagaaggugaacacccacaauugaaauucaagaaauga

SEQ ID NO: 5118 - RNA, 3372 nt, Artificial Sequence
  Cas9 variant
auggcaaaaauauuaggacuagaccuaggaacaaacagcauaggaugggcauuaauagaugauguacaaaauaaaauuuuaggaguuggaucuagaaucuucccaaugggcguagaaaaucuaggagacggcgauggggaaaucaguaaaaacgcaagcagaacgggcacucgaggagugagaagacaauucuuucgaagaagauuacgaaagaaaguauuauuaaaagcacuaagcgaaaauaacaugugcccaaugaucacaucagacuucgacaacuggaaaaagacaaaacaauuuccaagugaaaaauuagcaucaugguucgcuuuaaauccauacgaauugcguaauaaagcacuaagcgaaaaacuuacacuagaagaaauaggcagaauauucuaccaccuaauucaacgccguggauucuugagcaauucaagaaaaggaggcacagaugacggagcuauauucaaaggaaauccaaaagaaggcaaaaucggcauaacagauacacaagagucuauacaagacaaaacacuagguagcuaucuauuugaaauauauccaaaggaaaaucaaccauuucaaaauggauuagaaagaauaagaaaccguuacacaguuagaaaaauguauguagacgaguucgaaaugauaugggaaaaacaggcucaauacuauuccaaucucaaugaagaucucaaaacacuauuugggggaagaaaauuagauggauauaaagaagauggaauacucuuucaucaaagacccuuaagaucacaaaaacaccuagucggaaacuguguauucgaaccaaacaaaacgaaauguccgaucucugcuaucccauuugaacaauuuagaguauggcaaugggucaauacaguagaauauaauggaaagaaaauaagccaagucgaaaaagagaaaauaguagaauuuuuauaugcaaaugacaaaacagauuuuaagaaaauaagaaaagccauaggcaaagaauccacagaguucaaauucaacuauaaagacgaugauaaaauagugggaacauacacaguuagccaucucagcaacaagaaauauuuuggaaagaaaugguuugaauuuagcgaaaaagaacaagaagacauauggcauauacuguauuucuuugauucuaaaucuaacuuaaaagaauacgcaauuaaaaacuggaauuuuacagaggaacaagcugaaaguauagcgaaauuuaaugucaaagacgguuacagcagcuuaucaaggaaagcaauaaguaacauucuaccguucuuaaaacucggauucacauacgacgucgcaguagucuugggaggcauuaaaaacguuuuuggacaugaaugggaaaaacuuucagaugaaaagaggaacuuuuuaaucgacaauguagaaggcauugucagaaguaaaacaaaaggaggauucauagaugucauaaaagacauauuaagaaaugauuauaauauaagcgacaaccaacuucguaaacuauaucaucacucagcuacaaucuauguugcggaacuuuuagaaaaacuacccguugggaaagaagcagauaaagaaauccaaucgauacgaaauccaaucguaauaacagcuuuguucgaauuaagaaaacuugucaaugaacugaucgacgauuuugguucaaucgaugaaaucaaaguagaaauggcaagggaucuaaaaauaucaaaaucgcaaaggaauaaaauccgaagagaacaaaagaggcuagaaagagaaaacgauagagugaaagcaaggcucuuagaagagggccaacgaaucacacaugacaacauacuacuauacaaauuaugggaagagugcaagaaaacaugcccuuacacaggaaacccgauaccuuuauauaaacucuucacuggagagauccaaauagaacauauacaccccuggucaagaagucuaaaugauucauuugcaaacaaaacacuauguuaugcagaugagaacaggaagaaaggggacaaaacacccuacgaauuuuacggaaacgacgagagcaacuggucagcaauuaaagaaagagccuuaaaauuauuuucagacaccaaagaauauccaaacgccuaccaaaaauuuaaaagauucguccaacauaaauucgaugaugacuucaguucacgacaacuuaacgacacucgcuacauauccaaagaagcgaaaaauuacuuaagcaaaauauguaagaaaguagcaguaagccccggacaggcaacaucaaacuuacgacaaaaauggggcaugaauaauaucuuaaacgaugaaaacgagaaaacacgagaagaucacagacaucaugccauagacgcguugguaauggcuugcacaaaaauaaguuacguucaagaauugaguaaauggaaucgauauaauaggaacgcagaacuaaagaaauuccccuuaccaugggaaacauucuggucagacgcaaaucgugcaguagacaaaauucucauaucacacaagaaaguauccaacgauauaacaggcaggacacacaucagugagaaaaauggaaagaaauauaaaaacguaggaguagcagcaagaggacaguuacacaaagaaacaguauacggaaaacgaacuuuuaauggagaagaagccuuccacguacguaaaaccauugauucacugacgacagaaaaacaacuagaaaaagucguagaugaaucaauaaaacuauugauaaagaaaagaguacaagaacuaggagguuuuguuaaaggggcaauaccagccaauacauucuuuguaguagacgaaaacggaauaaaacaaccacaaaucuucuugccaaauaaaaauggagccccaguaccaguauugaaagugagaaugaaagaaaauauaggaggagcagaaaaauuaaaagaaaauguuaaccaauggguaaauccaagaaauaaucaccauguauuaauauauaaagacgaaaaaggaaaucuaaaagaagaaguagugacauucuggacuguaguagaaagaaaacgaacgggacaaucagccuaccaauuaccauuugauggaaaagaaauuguaacaacccuacauauaaaugacauguuucuuuuaggacuaaacgaagaagaaauaaacugggaaaacccagacuaugaaguucuaaaagaacaccuuuaucgcguccaaaaauuuacgagcggagauuauuacuucagaauugcuaaaacuucaaguauucaaaacgccaucgaaaaacaacaaauaaauucuuuuggguuuggcaaaaauggauggaguacccauaacccaaucaaaguuaaaauauccguaaguggaaaaaucucaaaaguauga

SEQ ID NO: 5119 - RNA, 3372 nt, Artificial Sequence
  Cas9 variant
augaacggauuaguucuuggcuuagauaucggaaucgguagugucggaguaggaauccuaaacaaagauacuggugaaauaauucauacaaacucaagaauauucccagcagcaaccgccgauaacaacguagaaagaagaaacucccgacaagcuaggcgacuaaaucgaagaaagaaacauaggggagcaagauugcacgaccucuucgaagauuaugauuuauuaauagauuuuucaaaaguaucuauaaauuuaaacccuuaccgccuacgagugcagggacuggacaauccccuaaccacagaagaacuauuuauugcacucaaaaacauaguaaaacgacgaggaauaucauaccuagaugaugccagcgaaaauggaggugcaguaaguucagacuaugggaaagcaguagaagaaaaucgaaagcuacuagcugaacagacaccaggacaaauacaacuggaaagauuugaaaaauauggacagguuagaggcgacuuuacagucgaagaaaaaggcgacaaacaccgccuaauuaacguauucucaacaucagcauacagaaaagaagccgaacgaauacuaaggaaacaacaagaauuuaauaaucaaaucacagacaaauucauagaagauuaccuaaaaauacucacagagaaaagaaaauauuaccacggaccagguaacgaaaaaucuagaacagacuacggaagauuccgcaccgacggaacaacacuugauaacauauucggaaucuuaaucggaaaaugcacauuuuacccaaacgaauauagggcauccaaagccucauauaccgcacaagaguucaaucugcuaaaugaucuaaauaaccucacaguaccaacagaaaccaagaaacucagcgaagaacaaaagaaaaccaucguagaauaugcuaaaucagccaaaacauuaggagcuucaacccuucuuaaauauauugccaaaaugaucgacgcaucaguugaucaaauacguggauacagaguugaugucaacaacaaaccagaaaugcacacuuucgaaguuuacagaaaaaugcaaucauuagaaacaauccccguaggcgaauuuucuagagaagugcucgacgaacuugcacacauacugacauuaaacaccgaaagagaaggaauugaagaagcaauuaacacaaaacuaauggacguauucagucaagaccaaauacuagagcuaguacaauuccguaaaaauaacuccaguuuauucucaaaaggguggcacaacuuuucacucaaacucaugauggaacuaaucccagaacuauaugaaaccucugaagaacaaauggcaauccuaacgagacugggaaaacaaaaauucaaagaaaccucaaaaagaacaaaauauauagaugaaaaagaaguaacugaagaaauuuacaacccaguggucgcaaaaucaguacgacaggcaauaaaaauuaucaaugaggcaaccaagaaauaugguauauuugacaacauaguuauagaaauggcaagagaaaacaacgaagaagacgcuaagaaagacuacaucaaacgucaaaaagcgaaccaugaugagaaaaaugcugcaauggaaaaagcagcauuccaguauaauggaaagaaagaacuacccgauaguauauuccacgggcacaaagaauuggcaacaaaaauaaggcucuggcaccagcaaggggaaaaauguuuauacacugguaaaaacauccccauauccgauuuaauacauaaucaauacaaauacgaaauugaucacauacucccacuaagccuaucauucgaugauagucuaagcaacaaaguacuuguauuagccaccgcaaaccaagaaaaaggccaaagaacaccuuuccaagcucucgauucaauggacgaugccuggagcuaucgagaguucaaaucuuaugucaaagacuccaaauuacuaggaaauaaaaagaaagacuaccuucugacagaagaagauaucagcaaaauagagguaaaacaaaaauucauagaaagaaaccuagucgauacacguuauucaucgcgcguaguacuuaacacucuccaagacuucuacaaagcacacaaauuugacacaacuauaaguguuguccgcgggcaauucaccucacaacucagaagaaaauggggacuugaaaaauccagagaaacauaucaccaucacgcagucgaugcacucaucauagccgcuucuucacaauuaagacucuggaagaaacaagcaaacccacuaauaucauacaaagaagaucaauucguugacagcgaaaccggugaaaucauuagcuuaacagaugacaaauauaaagagcuaguuuucaaagcaccauacgcccauuucguagauaccuuauccucgaagaaauucgaagauaguauacuauuuucauaccaaguugacucaaaauauaaccguaaaauaucagacgcaaccauauacgcaacucggaaaguuaaacuugauaaagacaaaucugaagaaacauacgucuuaggcaaaauaaaagauauuuacucacaagccggguacgaugcauucauaaaaauauauaauaaagacaaaaguaaauucuuaauguaucacaaagacccacaaacauuugaaaaaguuauagaggaaauacuuaggacauauccaucaaaagaguucaaugagaaaaauaaagaagugccauguaauccuuucgaaaaauaccgacaagaaaacggcccaauccgaaaauacucaaagaaagguaacggacccgaaauuaaaagccuuaaauacuaugauaaaaauauaccagaaucauucaucaauauuacuccaaguaacagcaaaaacaaggucauauuaagacaauuaaauccauggcgaacugacguauacuucaaucaccaaacagaaaaauacgaacuacuaggucuaaaauacgcagacuuacaauuugaaaagaaaacgggcacauauucaauaacaaucgauaaauauaacgaaauaaaagaaaaggaaggggucggagaacaaucagaguucaaauuuacacuuuauaaaaacgaccuguuacuaaucaaagauacgaaaaacaaugaaaaacaaauauuccgauuccuaucaagaacaaugccuaauguaaaacauuacguagaacugaaacccuacgauaaagccaaauuugacggaaaccaaccacugauaacaauauucggcaaugucgcaaagggcggacagugucuaaaaggacuaaacaaaucuaacauaagcauauuuaaaguaaaaacagauguacugggcaacaaacacuucauaacaaaagaaggagaaaaaccaaaauuaaaauucuga

SEQ ID NO: 5120 - RNA, 3378 nt, Artificial Sequence
  Cas9 variant
augaauggacuaguacuagggcuugacauaggcauagccucagucggaguggguauucuaaauaaagaaacaggcgaaauuauacacguaaacucccgcauauuuccugcugcaaccgcagauucgaacguagaacguagaggauuucgacaagguagacgcuuaggaagaagaaaaaaacacagaucagcccgcuugaacgauuuauuugaagaauucggguucauaacugacuuuucagcugucccuuuaaaccuaaacccuuacgcauuaagaguaaaaggacuaagcgaagaacuaaccaacgaagaacucuucauagcauuaaaaaacaucaucaaaagaaggggaauaagcuauuuagaugacgcuagugaagauggagaaacagccucgaacgaauacggaaaagcaguagaggaaaauagaaaauuauuggcugacaagacaccaggacaaauccaauuagaacgauuugagaaauacggacagguaagaggagacuucacaguagucgaaaacggugaaaaccaccgacuaauaaacguauucucaacaucagcuuauaagaaagaagcugaacguauacuacguagacaacaagaauucaaugucagaaucucagacgaauucaucgaagcuuacuuaacaauucuaacuggaaaaagaaaauauuaccaugguccuggaaacgaaaaaucacgaacagacuacggccgauuucgaacagaugggacaaccuuagauaauauauuugguauauuaauuggaaaauguacuuucuacccagacgaauaccgcgcagcaaaagcauccuauacagcccaagaauucaaccugcuaaaugauuugaauaaucuuacuguaccaacagaaacaaagaaauuaagaccagagcaaaaacgacaaaucguugaauacgcaagaacagcaaaaaccuuaggaacaccaacucuauuaaaauacauagcgaaauuaguagacggaucaauagacgauauaaaaggauauagaaucgacaaaagcgauaaaccagaaaugcacaccuuugaugcauauagaaaaaugcgcacucuagaacucguagaugucgauauauuaucgagagaaacuuuagaugaucuagcauauaucuuaaccuuaaauacggaaagugaaggaauucuggaagcuuuaaauagcaaaaugccuggaaccuuuacaaaagagcaaaucgaugagcuaauucaauuuagaaaaaagaacagcgcagucuuuggaaaaggauggcacaauuucucacuuaaauuaaugaaugaacuaauaccugaauuauacgaaacaagugaagagcagaugacaauucugacacgcuuaggaaaacaaagauccagagaaauaucaaaaagaacaaaauacauagacgaaaaagaacuaaccgacgaaauauauaaccccguaguagcaaaaucaguaagacaagcgauaaaaaucauaaaccuggccacuaaaaaauauggaauauucgauaacauaguuaucgaaauggcccgagaaagcaacgaagacgacgaaaaaaaagcgauccaaaauguccaaaaagcaaaugaagaugagaaaaaagccgcaauggaaaaagcagcagaccuauauaacggcaagaaagaacuaccugauagcauuuuccacggacauaaagaacuagcaacaaaaauuagacucuggcaccaacaaggcgaaagaugccuuuauacgggaaaaaacauaagcauucaugaccuaauccauaacccccaccaauaugaaauagaucauauauuaccauuaucauuaagcuucgacgauggacuagccaacaaaguauuaguacucgcaacagcaaaucaagaaaaaggucaacgcacacccuuucaagcacuggacuccauggaugaugcauggaguuauauugaauuuaaacaauacgucagaaacucaaaaucacuaaguaacaaaaaaaaagacuaucuacucaccgaggaagauauuucaaagaucgaaguaaaacaaaaauuuauugaaagaaaccuuguagacacaagauacucgagccgcgucguuuuaaacacucuucaggaauuuuacaaaaccaacgacuuugauaccaagauaucuguaguaagaggccaauuuacaucacaacuacgacguaaauggaaaauagaaaaauccagagauacauaccaccaccaugcaguagacgcacucaucauagcagccuccucacaacuaagauuauggaaaaaacaaaauaacccauuaaucaguuaccgcgaaggacaacuaguagauccggaaacaggagaaauccuuucccugacagaugaugaauacaaagaacuaguucuaaggcccccauacgacuauuuuguagacacauuaaaaucaaaaucuuucgaagacaguauauuauuuucauaucaaguagacaguaaauacaaccggaaaauaucugaugccacaauauacggcaccagaaaggcacaacuagggaaagacaaacaagaagaaacauaugucuuaggcaaaaucaaagacauuuacucacaaaaaggcuacgaggacuuuauuaaacgauauaaaaaagauacaacccaauuucuuauguaucacaaagacccacaaacguucgcgaaagugauagaggaaauacuaaaaacauacccagacaaagaacucaacgaaaaagguaaggagauaccaugcaauccauucgaaaaauacagacaagaaaacgggccaauccgaaaauauaguaaaaaaggaaaagggccagaaauaaaaucacuaaaauauuacgacaauaaacuggggaaccacauagauaucacaccagugaauucucaaaaccaagugguacugcaaucacuaaaacccuggagaaccgacgucuauuucaacccucaaacaucaaaauacgaauuaaugggacugaaauacucagaccuuagauucgaaaaagguucagguagcuauggaauaagcccagaaaaauacaauaaagucaaagcaaaagaaggaguggacgaagauagugaauucaaauucaccuuauauaagaacgaccuaauauuaauaaaagacacugagacgggagaacaacaauuauucagauauggauccagaaacgacacaucaaaacauuacguggaacuuaaacccuacgaaaaagccaaauuugaaggaaaccaacaauugaugaaucuacuuggaacaguagcuaaagguggccaauguuuaaagggaauaaacaaaccuaaccuuucaauauauaaagucaaaacugacguccuaggaaacaaauauuucauaaaaaaagaaggagaccagccucaauuaaauuucaaaaaaaaaauauga

SEQ ID NO: 5121 - RNA, 3378 nt, Artificial Sequence
  Cas9 variant
augaccagcaaacaagaaaauuuaggagcauuaacguucggacuugacauagggauugcaagugugggcugggccgugcugggcgaaaauagaauaauagacuuaggggucaggugcuuugacaaagccgaaacagcaaaagagggagaaagccugaaucucgcaagacgaauggcuagguuauugagacguagauuaagaagacgcgcauggagauuaacaaaauuagccagauuacuaaaaagagaaggauugauagcagacgcgaaucuguuuaaaaauaaaauagagaaaaauaccccuguucccaaaaguaguuggcaauuaagaguagacgcauuagaccgaaaacuaaacgccgaagaaugggcaagaguaauuuaucaucuaugcaaacacagaggauuccacuggauaucaagagcggaagaaaaagcagcugaauccgauuccaaaggagaaagcggaaaaguuaaacagggauuagccggaacaaagaaacuaaugcaagagaaaaauuacagaacagcagcagaaaugguacuagcagaguucccagaagcacagaggaacaaacaaggagauuacucaaaagcauuaucaaggauccuccuaggugaugaauuaaagacauuauuugaacaccaacgaaaacuagauucaccuuuugcaacggaaaaauuagaagcagcgauauugggaaauggcgacagaaaaucaggcuuauuuugggcgcaaaacccagcguuagcaggaagugauuuguuaaaaauguuagguuauuguacuuuugagaaaaccgaauaucgagcaccaaaagccagcuucacagcagaacgucacguaugguuaacaagacuaaauaaccuaagaauaguaguagaugguacaacacgaccacuaaacgaagcagaacgcagaauugcacuauuaaugccauaucaacaagccggcgauuucacauacaaacaacuuaggacugcguuaacuaaagcagguuuucuaccagaaucauuuagguauacaggauuaucauacgcuaguggacaaaaagcaggcgagaaaacuaaagacccugaaagcgcugcucucguuaaauucccugcauggcaagaauuacguaaaacacuagaaaagaaagaacuagcuucagaauggcaaaagauaucaacugaugcgcuagacggaaaaccacagcuacuagaucaaauagcuugggugcucagcguauauaaagaugaugacgaaguaaaggccgaauuaucgaaacuuaaucuaccaaacgccgagaaaaugauagacgcacuacuggauauaagauuugacaaauuuucuaauuugagcuuaaaagcauuauguaaaauuguaccuuuaauggaacaaggucaaagauacgacgaagcuauagcgaauauaccagaauacggucaucacagucaacuacauaaaguaggggcaggagaacauaaauauuuaccacccuucuacaaggaacgagauaagacaggaagaaugguauuuaaugacgacauggauauacccaggaauccaguaguuuuaagagcauuaaaucaagcgcguaaagucguaaaugcuuuaaucaaaaaguaugauucaccucaugaagugcauauagaaauggcucgagauuuaucaagaccacuugacgaaagaagagaagucgaaaaacuucaaaaggaauuucgagacaacaacgaaaaggguaaagcacaauuugcacaagacuucaauauaguaggcgcgguaaaagggaaagaauuugagaaauaccaacuauaucgagaacaacaagguaaaugcgccuacucaauagaaccuauggacauucacagacuauuugaacaaggauacgucgagauugaccacgcacuaccauacucaagaaguuuugaugacaguaaaaauaacagagucuuaguucuagcaaaagaaaacagagauaaagggaaucgaacaccauucgaguaucucggaggaaaagacaauucagaaccauggcgacaauuuguugcuuuuguugagggaaauaaagcauauagacuggcaaaaagaucaagauuacuaagaaaagacuucggagauaaagaagcaaaggaguuccgcgaaagaaaccuaaacgacacaagauacauuuguaaauucuuuaaaaacuauguagaacaguaucuucagcuacacgaagacucagaagcaaaacguugcguaguucuauccggacaaaugacaucguuucuaagggcacguuggggauuaguaaaaguuaggggugacagcgaccgacaucaugcacucgacgcagcugucguugcugcuugcucacauggaaugguuaaaagacuaucugacuauagcaggaggaaagaacuugaacaggucagagagggauuuguugauguagacaccggggagauagucaauccagcaauguuccaacaaguccaagagcauuuucccaauccauggccucauuuuagagaugaagucaaauuaagauuaucaauggaugacccagcuuuguuacggagcgaaauggaaaaguucggcacuuacacaccggaagcacuacaggcacuacacccuuuauuugucuccagagcaccucaaagaagaaauucaggagcagcacauaaagauacuauauacgcucaaccgaaaagauuaguagcccaaggaggcguaacacaaaaaguugcacuuacaaguuugacauuaaaggaccuagauaaacuaauagauccacaccguaaugauaaacuauacacagccauaagagcacgauuagaacaacacggagguaaaggagacaaagcguucccaagcucuaaccccuuacggaaaccagauagugagggaaauccaacuggaccaauagugcgcggcgucacaaugguaauagauaaacuaucaggaaucccuauaagagggggaauagcuaaaaaugacucuaugguaaggguagauguauuuacgaaagccaauaaguuccauuuaguuccagucuauguccaucacacaguggcuaaagcccuaccuaauagggcaguaguagcuuucaaagacgaagaugaguggacauuaauugaugacagcuuugauuuuuguuuuucguuacacccgaacgaccuaguacaaguacaacaaaaaggaaaagcaggaaugauuggauauuauagcagcugccacagaggaacaggaaacauuaauuuaugggcacaugaccgaaacuuacagguaggaaaagauggaaugauagaagguauuggagugaaaacagcauugucacuagaaaaauucaacgucgaugugcuaggcaaccgauacccagcaccaccggaaaaacgaagagauuuagcauga

SEQ ID NO: 5122 - RNA, 3378 nt, Artificial Sequence
  Cas9 variant
augacagacagaaucucauuaggacucgacaucgggguagcaagcguugguuucagcguacuagauauagacaaaggaaaaguaauagaacuaggagcacgauuauuuaacgcaacagucgcggcaggaaaucaagacagaagagacaugaggggcucaagacgacuauugaacagaaacaaacagagacgaaaagacguaucuaaauuauuucaagaauacggacuguuggacaacuucgacagagacaacuuucacacagccuuuaauaacaauuggaauccauaugagcuacguguuaaaggcuuaacaaaacaacuaaauaaagaagaacucgcagacucauuguaucaaauaauaaaaagacgagggauaagcuaugcauuaaaagacgcugacgcaaacgaagacggaacagauuacucaucauccuuaaaaauuaauucgcaagaacucauagaaaaaacgccagcgcaaauucagcuacaacgacucaacgauuacggcaaaguacgaggcaaaguaaucgucggagacgacaucgacgaccaaaaaguacuuuuaaacguauucccgaccaaugcauacgaaaaggaggcacgccaaauaauagcuacacaacaacaauuuuaucccgaaauauuaacaggagaauuuguaaaagaauacugucagauauuaacacgaaaacgagacuauuucguugggccaggcaacgaaaaaucacgaacagacuacggaauauauaaaacagacggaagaacauuggacaaucuuuuugaagaauuaaucggacaugacaaaaucuacccagacgaacuacgagcgucagcagcuucauacaccgcucaacucuuuaacgugcuaaacgaccuaaauaauuuaagaauauuaagcuacgaagacggaaaauuaacacaaauagacaaagaaaaaaucauagcagaaauaaaaaauaauaccacaguagucaacauguuaaacguuauaaaaaaaguaaccggcugucaaaaagacgauaucaaaggauucagacuuaaugaaaaagacaaaccagaaauuucaucaaugccuauuuacagaaaagcgcauaaggauuuccuaaagguaggcaucgauauaacugacuggccaauagacuucaucgacagacuaagcuuuauauuaacauuaaacaccgaaaauggagagauaagaaaacaaauaaacaaaagauuaguccccgacuuugacuucuuaaaugacgaucuaguacaacucauuaucgauaacaaagacagcuucgacauaaaaacaaauaacaaauggcaucgauuuuccuuaaaaaccaugaacaaacuaauccccacaaugaucgaaagaccaguagagcaaaugacucuccucacagaaaugggccuaauaaaaaaagauacuaaaagauucgaaggaaauaaauaucucccauacaaagaaauagcuaacgauauauuuaacccgguagcgucaaaaucaguaagagaagcucuaaaaauagugaacgcaguuuuaaaaaaauauggacauauagaauacauaguaauagaaaugccgagggauaaaaaucuugacgaagaacgcaaacaaauagccgacuuccaaaagaaaaauaaaaaaauaaaagacgcagcauucaaugcguucguaaaagcagucgguucaaaaaaaaauguaaaaauugcacuaucaaaaaacaggaaauuacaaaugggaauacgauuauggcaucaacaacaaggcaucgauccauacaauggggaagaaauaaacgcgaacgaucuaauaagcaacccagacaaauucgaaauagaucacauaauaccacaauccauuagcuucgaugauggaauaaauaacaagacguuaugcuucgccucgaugaaucaaguaaaaggacaaaagacaccauacgaauuuuuaaacgaaggccacggacagggcuacgcaaaauucaaagcgauagucuccaagaacaaaaacuucucaaaagcuaaaagagauaacuacuuauucgaagaaaacgucucaaacaucgaaacaagaaaaagguucuuaucgagaaaccuagucgacacacgcuauaguagccgaguaguucuaaacucacuacaagaauuuuuucacgaaaaaagugaugacacaaaagugacagugauaagaggaaaauucacauccaacaugagaaaacauuggcacaucgacaaaacuagagauacauuucaucaucaugcaauagacgcaagcauuauagcagcaacaccuuuccuccgcauguggaaaaaaggcagcacaauauucccuaccaaaaucaacgaaacaucaauagacauagaaaccggagaaauacucgacgauaaaaauuuugauaaaguaauguacgaagaacccuauuccggguucauaagcgaaauaaugaacgccgaugaccgaauaaaauucagccaucaaguagacaagaaaaugaauagaaaaguaucagacgcaacaauauauagcacacguauaggaaaacuaaguaaagauaaaaaagaugcggaauacguaguagcaaaagucaaagacauuuauucgguagauggauaugagaacuuuaaaaaaguauacaaaaaagauaaaacaaaauucuuauuauacaaguacgauccacgaacauuuucagaauuggaaaaaaucgucauagacuauccagacaaaaucgagaaaguccagaccaauggcaaaauuaaagcaguagauaucagcccuuucgaacuauacagaagagauaacggaauggugagaaaauauucuaaaaaaaccggacccgccauaaaacaacucaaguaucuagacaaaaaacuagguucacacauagacauaaccccaaaaaacgcaaacaacaaacauguagugcuacaaagccuuaaaccauggagaacagacguuuauuugaaccaugaaacuggggaauacgaaaucaugggcauuaaguauucagaccugaaauuuaacaaaaacgaaggauacggaauaaaaaaagacaaauaucuuaaaauaaaaaauauagagggcguaagugaaaacucugaauucauguuuagccuauaccgaaaagaucggauaaaaguacaagauauggaaacaaaugaaucgguugaauuacuauucuggucaagaaauuuuagcaacaagaaguaugcagaacugaaacccauaagccaaauagauaaugauaaaguuuuacccauauauggaagagguagacuuauaaaaagacuaaucccaaaaaauuguaagaucuggaaagucaacacaaguauauuaggugacacauacuacuuagaaaaagaaaguaacuauccccaaaagauacuagauuga

SEQ ID NO: 5123 - RNA, 3381 nt, Artificial Sequence
  Cas9 variant
augaacggcuuaguacucgguuuagacauuggaauugccucaguaggugucggcauccuuaauaaagaaacgggcgaaauaauacacgccaauaguagaauuuuccccgcugcgacagccgacucaaacguggaaagaaggggauucagacaaggaagaagauuaggcagaagaaagaaacacaggucagcgcgacuaaauaacuuauuugaagaguucggauucauaacagacuuuuccgcaauaccacucaaucuaaaccccuaugcgcuacgaguaaaaggacuaucagaagaacuaacaaaugaggaacuauucauagcccuaaagaacauuauaaaacgaagaggaauaucauaccuagacgaugcaagugaagauggugaaacugcaucgaaugaauaugguaaagcugucgaagaaaauagaaaacuauuagcagacaaaacucccggacaaauccaacuagaaagauucgaaaaauacggucaagugcguggagauuuuacgguaguggagaacggagaaaaccauagguuaauaaacgucuucucaaccuccgcauacaagaaagaagcagaaagaauauuaagaagacaacaagaguucaacguccgaaucucggacgaguucaucgaggcuuaccuaacaauauuaacaggaaaaaggaaauauuaccauggaccagggaaugagaaaagccgaacggauuacggacgauuccgaacagauggaaccacacucgacaauauauuuggcauuuuaauuggcaaaugcacauucuacccagaugaauauagagcagcaaaagcaagcuauacggcacaagaauuuaaccuacuuaaugaccuaaauaacuuaacaguuccuacagaaacuaagaaacucucacccgaacaaaaacgccagauagucgaauaugcaagaacagcgaaaacacucggcacuccuacacuacuaaaauacauagcgaaauuaguggacgggucuauagaugauauaaaaggcuacagaauagacaaaagugacaaaccagaaaugaugcauacguucgaugccuaucgcaaaaugagaacucuagaucuuguuaacauagaugcauuaucgagagaaacacuugacgaccuagcacacauauuaacccuaaacacagaaucugaaggcauccuagaagcacuaaacaguaaaaugccaaguacauuuacuaaagaacagaucgaugaauugauacaauucagaaagaaaaacagugcagucuucggcaaaggauggcacaacuuuagucuaaaacugaugaacgaacuaauuuccgaacuuuaugaaaccagcgaagaacaaaugacuauucuaaccagacuuggaaaacagagaucaagagaaauaucaaaaagaaccaaauauauagaugaaaaagaacuuaccgaagaaauauacaacccaguaguagccaaaagcguuagacaagcgauaaaaauaauaaacgaagcgacaaaacgcuauggaaucuuugauaacauuguaauagaaauggcacgagaaaacaacgaagaagacgccaagaaagacuacauaaaacgacaaaaagccaaucaagaugagaaaaacgcgucaauggaaaaagcagcauuucaauacaaugguaagaaagaacuaccagacaguauauuucacgggcacaaagaauuagccacaaaaauaagacuauggcaccaacaaggcgaaagaugucucuacacuggcaaaaacaucucgauccgagauuuaauacacaacccacaucaauacgaaaucgaucauauauuaccauuaaguuuaucauucgacgacggacuagccaauaaaguauuaguacuagcuacggcaaaccaagaaaaaggacaaagaacacccuuccaagcuauagacucaauggaugacgcauggucuuauagagaguucaaacaauauguaagaaauagcaaaucacuauccaauaaaaagaaagauuaccuacuuacagaagaagauaucaguaaaauugaaguaaaacaaaaauuuauagaaagaaauuuaguagacacaagauacaguucuagaguaguccuaaacacacuucaagaauuuuacaaaaccaacgacuuugauacaaaaauuuccguaguccgcggacaauuuacaucacaauuaagaagaaaauggaaaauagaaaaaucaagagauacauaccaccaccacgcaguagacgcccuuauaauagcagccagcagccaacuucgauuauggaagaaacagaacaacccccugauaucauacaaagaagggcaauuuguagacccagaaacaggagaaauauuaagccucacagacgacgaauacaaagaacucguauuuaggccacccuacgacuacuuugucgacacacuuaaaagcaaaucguucgaagacaguauucuauuuaguuaccaaguugauagcaaauacaauagaaaaauaagcgacgccacuauauacggaacccgaaaagcucaauuaggaaaagauaaacaagaagaaacguacguacugggaaaaauaaaagacauauacagccaaaaaggcuacgaagacuuuauaaaaagauacaauaaagacgaaacacaguuccuaauauaucacaaagauccacaaacauucgaaaaaguuauagaagaaauacuaaaaaccuauccagacaaagaacuaaacgaaaaaggaaaagaaauaccuugcaauccguucgaaaaauaucgccaagaaaacggaccaauacgaaaauacucaaagaaaggaaaagguccugagauuaaaauacuaaaauauuaugauaacaaacuugguaaccacauagacauaaccccagucaauucacaaaaccagguaguccuccaaagccuaaaaccuuggcgaacagauguuuacuucaacccaagaacauccaaauacgaauuaaugggccuaaaauauagugaucucagauucgaaaaaggaagcgguucauacgguauaaguccagaaaaauacaacaaaguaaaagcaaaagaagggguuaacgaagacucagaguucaaauucaccuuauauaaaaaugaccuuauucuaauaaaagacacagaaaccggcgaacaacaauuauucagguacggcucaaggaacgauacuucgaaacacuauguagaauuaaaaccuuacgaaaaagcaaaauucgaaggaaaucaacaacuaaugaaucugcucgggacaguugcuaaaggagggcaaugcuuaaagggaaucaauaagccaaaucuaucaauuuacaaaguaaaaaccgacguguuaggcaauaaauacuucauaaagaaagaaggagaucaaccacaacuaaacuuuaaaaagaaauuuuga

SEQ ID NO: 5124 - RNA, 3381 nt, Artificial Sequence
  Cas9 variant
auggcgaguaaacaugaaaaucucggagcauuaacauuuggauuagacaucggcauagcgaguguuggaugggcuguacuaggagaaaaucgaauaauagaucuaggaguacgauguuuugauaaagcugaaacugcgaaagaaggugaaucauuaaaccuagcuagacgaacugcaagacuauuacgaaggagacuaagaaggagagcauggcgucuaacaaaacuagcaagauuacuaaaacgagaaggauuaaucgcagacaccaauguuuuucaaaaaccauucaaucuaaaagacgcaaacgaaaaaggacuuaguuucuggcaacuaagaguagaugcucuagacagaaaauuauccgccgaagaaugggcaagaguuauauaucauuuauguaaacaccgagguuuucauuggauaagucgcgcagaagaaaaagccgccgagggcgacagcaaauccgagggaggaaaaguaaaacagggacuugcagggacuaaaaagcuaaugcaagagaaaaauuauagaacagcagcugaaaugguauugacagaguucccagaagcucaaaggaauaaacaaggugacuauaguaaagcccugagcaggauacuuuuaggugaugaaaugacucaacuauucaaacaccaacgagaauuaggaaacccacaugcgaccgaaaaauuagaagcugcaauucuaggaaacggagaccauaagagcggauuguuuugggcacaaaauccagcccuagcaggaaacgacuuacuuaaaaugcuuggacauuguaccuucgaaaaagcagaauaucgaguaccaaaagcaucauuuacagcugaaaggcauguuuggcuuacuagauuaaacaauuugcgcauuguugucgauggaacaacaagaccuuuaaaugaagccgaaagacauuuagcauuauuaaugccuuaccaacaggcgggagaucuaacauacaaacaauuaaggacugcacuaacuaaagcaggauaucugcccgaaucguuccgauauacagguuuagcguacgcaucagggcaaaaagcagaugaaaaagcgaaagacccagaaagcgcaccucuaguaaaauuaccagcauggcaugaacuaaggaagacauuagagaaaaaggaacuagcuagugaauggcagaaaauaagcucugaugcauuagacggaaaaccacaacuauuagaucaaauagcauggguccuuagcguauauaaggaugauacagaagucgaagcagaauuaugcaaacuaaauuuaccuaaugccgagaaaaugaucgacgcacugcucgacauaagguuugauaaauucaguaaccuaagccuuaaggcuuuaagacaaauaguaccccuaauggaacaaggucagagauaugacgaagcaguugcuaauauaccugaauauggacaucauucucaacuacaugaaguaggagcuggggaacauaaguaccuaccaccuuuuuacaaagaacgagauaaaacagguagaaugguauuuaacgaugauauggacauaccaagaaacccugucguacuaagagcacuuaaccaagcacgaaaagucgugaaugcuuuaauaaaagaauacggcaguccccacgaaguacacauagaaauggcacgagaccuaagucgcccauuagaugaaagacgagacguagaaaaauuacaaaaagaauuuagagauagaaacgaaaaagacaaggcuuuauuugcacaagauuucaacauuguaggagcuguaaaaggaaaagaauuugaaaaauaccaguuauauagagaacaacaagggaaaugugcauauucaauagaaccaauggauauucacagacuuuuugaacaaggauacguugaaauagaccacgcauuaccauauaguagaucauuugaugauagcaaaaauaacagaguucuaguauuagcaaaagaaaauagagauaaggguaauagaacacccuuugaguaucuugguggaaaagacaacucagaacgauggagacaauuuguugcauucguagaagggaauaaaagcuaucgauuagccaaaagaaguagacuguuacguaaggacuuuggaaaagacgaagccaaaggcuuuagagaacgaaaccuaaaugauacuagguacauuuguagauucuuuaaaaacuacguagaacaauaccuacaacuucacgaagauagugaugccaaaagguguguaguacuaagcgggcaaaugacgucauuccuaagagcaagauggggucuaguaaaagucaggggagauagcgauagacaucacgcacuugauggggcgauaguugcagcauguucacacaguaugguaaaaagacuaagugacuauucacggcgaaaagaauuagagcaaguucgagcaggguucgucgacguagauacaggagaaauaguuaauccagcaauguuucaacaaguacaagaacacuucccgaaccccuggccacauuucagagaugaaguaaaauuacgacuaaacgucgacgauccagcauuauuacacucugaaaugaacagauucgguacauauucuccggaagccuuaaaagcucuacgcccauuguuuauaucacgggcaccgcaaagaagaaauaguggugcagcacauaaggacacgauauaugcgcaaccagaacgauuaguagcacaaggugguguaacccagaaagucccacuaaccucuuuaacacuaaaagauuuagauaaacuuauagacccacaucgaaaugaaaaauuauacuccgccauaagaauacgucucgaacaacauggaggaaagggcgauaaggcuuucccugcaucuaaucccuuaagaaaaccugauagcgaaggaaacccuaccggaccaauaguaaggggagucacaaugguuauagacaaauuaucugggauaccuauaagaggagguauagcuaaaaacgauucgaugguacgaguagauguauuuacuaaagcugguaaauuucaccuaguccccguuuacguacaucacgcaguugcaaaaguacucccaaaucgagccguaguggcauauaaggaugaaacagaauggacucuaaucgaugauggcuuugauuucugcuuuaguauguaucccaaugaucuccugagaaucaaacuaagaaaugcuagucacuuaggauacuaugcaaguuguaacaggucaacgggagcaauaaauuuguggagccaugaccgaaaccaacaagucggaaaagacgggaugauagagagcauagguguaaaaaccgcacugaauguggaaaaacuaaacauagacguacuagguaauagauacccagcgccaccugaaaaacgacgagacuuagcguga

SEQ ID NO: 5125 - RNA, 3384 nt, Artificial Sequence
  Cas9 variant
augagcgaucucguccuggguuuagacaucgguaucgggagcguaggaguagguauacuuaacaaaguaacaggcgagauaauucauaagaacucaagaaucuuuccugcagcccaagcagagaauaauguagaaaggagaaucaaccgccaaggaagaagauuaaccagacgaaagaaacaucgcaggguaagacuaaaucaccuauucgaagaauccggacuaauaaccgauuuuacgaacguaaguauaaauuuaaauccauaucaacuacggguaaaaggacugacagaugaacuaagcaaugaagaacuauucauagcacucaaaaauaugguaaaacacagagguauuucauaccuagaugacgcaagugacgauggaaauaguuccguuggagauuaugcacaaauaguaaaagaaaauucaaaacaacuagaaacaaaaacaccgggccaaauacaacuagaaagauaucaaaaauauggacaauuaagaggagacuucacaguugaagaagacggaaagaaacacagacuaauaaauguuuucccaaccagugccuacagagccgaagccuuacggauacuucaaacacaacaagaauuuaauccacagauaacugaugaauuuauuaauaguuaccuucaaauccuaacuggaaaaagaaaauacuaucacggaccaggcaaugaaaaaucccgaacugacuacggaagguauacgacaaagaaagacucugaagacgaauauaucacacuagauaauauuuucggaauauuaauaggcaaaugcacguuuuacccagaagaauauagggcagcgaaagccucauacacugcacaagaguucaaccucuuaaacgaucuaaacaauuuaaccguucccacugaaacuaagaaacucagcgaagaacagaaaaaucaaaucaucacaaacguuaaaaaugaaaaagcaaugggacccgcaaaacucuucaaauacaucgcaaaacuacuauccugugauguagcagauauaaaaggcuaucgaaucgacaaaagugauaaagcggaaauacacacuuuugaagccuaccgaaaaaugaaaacguuagcaaccaucgauauagaacaaauggaacgagaaaacuuagacaaauuggcuuacguccuaacacuaaauacugaaaaagaaggcauacaagaagccuuagaacacgaauuugcagacggaaccuuuucacaagaacaaauagacgagcuaguucaauuccgaaaagcaaauucaucaauauucggaaaaggauggcauucauucucaguaaaacuaaugauggaacuaauaccagaauuauaugcaacaagugaggaacaaaugacaauuuuaacuagacuaggaaaacagaaaacaacaucaucuaguaacaaaacaaaauacaucgacgaaaaacaacuuacggaagaaauuuauaacccaguagcagcaaaaucaguacgccaagcuauaaaaauaguaaacgcagccaucaaagaauacggagacuucgacaauauagucauagaaauggcgagagaaaccaacgaagacgacgaaaagaaagcaauacagaaaauacaaaaagcaaauaaagaugaaaaagaugcagcaaugcuaaaagcagcaaaucaauauaaugguaaagcugaauuaccacacaguguauuccauggacauaaacaacuagccacgaaaauacgauuauggcaccaacaaggagaaagaugcuuauacacuggaaaaacaauauccauccaugaccuuauaaauaacucaaaccaauucgaaauugaucacauacucccauuaaguauaaccuucgaugacucacuagccaacaaaguccuaguuuaugccacagcaaaccaagaaaaaggccaaagaacaccauaucaagcguuggacucaauggacgaugcguggagcuucagagaacuaaaagcauucguuagagacucaaaagcacuaagcaauaaaaagaaagaauaccuacuuacagaagaagacauauccaaauuugacguuagaaagaaauuuaucgaacgaaacuuaguagacacaagauacgccagcaggguaguacuuaacgcguuacaagaacauuuuagaguacacaaaacagauacaaaaguaaguguagucagaggacaauucacaagucagcuaagaagacauugggguauagagaaaacucgagacacauaucaccaccacgcaguagaugcuuuaauaauagcagcuuccucacaacuaaaccucuggaagaaacagaaaaacacucuagugucauauagcgaagaccaacuuuuagauaucgaaacaggagaacuaaucucagaugacgaauacaaagaguccguauuuaaagcaccauaucaacauuuuguagauacacuaaaaagcaaagaauuugaagauucaauacucuucuccuaccaaguugacagcaaauucaauagaaaaauuucagacgccaccauauacgccacaaggcaagcuaaaguugguaaagacaagaaagacgagacauacguacuaggaaaaaucaaagacauauauagucaaacaggauacgacgcuuucauaaaaauauacaagaaagacaaaagcaaauuucuaauguaccgacacgauccacaaaccuucgaaaaaguaauagaaccaauacuagaaaauuauccuaauaaagagcucaaugaaaaagggaaagaaguaccauguaauccauuccucaaauacaaagaggaucacggauacauaaggaaauacaguaagaaaggaaacgggcccgaaauuaaaucacuuaaguacuacgauucaaaacuagguaaucacauagauauuacuccuaaaaauucaaauaauaagguuguauuacaaagcguaucuccauggcgagcagacguauacuuuaacaaaacaacaggaaaauaugaaaucuuaggacucaaguaugcagaccugaaauuugaaaaagggacagggacauauaaaauaagcgaagaaaaauacaacgacauaaaaauaaaagaaggcguagauuccgauagugaguucaaauuuacacuuuacaaaaaugaucuacuauuaaucaaggacaccgaaacaaaagaacaacaauuauucagauucuuaucaaggacuaugccaaacguaaaacauuauguugaacuaaagcccuaugauaaacaaaaguucgaugacaaugaagaacuaauuaaaauccucgggauaguagcaaaaggaggacaaugcaagaaaggaguaucaaaaccaaauaucucuauauacaaaaucagaacugacguauuaggcaaucagcacauaaucaaaaaugaaggugacaaaccaaagcuggauuuuuga

SEQ ID NO: 5126 - RNA, 3384 nt, Artificial Sequence
  Cas9 variant
augaaugguuuaguccuuggccuagacaucggaauagcaucaguaggaguaggaaucuuagaaaaagacucugguaaaaucauacacgcaaauucgagaaucuuccccgcagcaacagcggacaauaauguugaaagacguacaucccgacaagcacgccgacuuaaucguagaaagaaacaucgaaguguaagauuacaugaccuuuucgaagaauacgggcuccuaacagauuuuucaaaagugucaaucaaccuaaaccccuaucaaauacgaguacaaggacuagacaaaaggcuuacuaacgaagaacucuucauugcacugaaaaacauuguaaaaagaaggggcauaaguuaccuagacgaugcaucagaagauggaggagcuguuaguucugacuauggaaaagcaguugaagaaaacagaaaacuauuagcccaacaaaccccaggacaaauacaacuggacagauucgaaaaauauggacaaguaagaggagacuuuacaguaguagaaaauggggaaaaacgaagacuaauaaauguguucagcacaagcgccuacagaaaagaagcagaaagaauacuuaggaaacaacaagaauuuaacaauaaaauaaccgaaggguucauagaagauuacuugacaaucuuaaccggaaaacgcaaauacuaucacggacccggaaaugagaaaagcagaacugacuauggaagauacaccacaaagaaagacucccaaggggaauauauaacacuagauaauauuuucggcauuuuaaucgggaaaugcacauucuacccugaugaauauagagcuagcaaagcaucauauacagcccaagaauuuaacuuauugaacgacuuaaauaaucuaacaguaccuacagaaacaaagaaauuaaguguagaacaaaagaaaaccauaguugaauacgcaaaaacugccaaaacccuaggggccucaacgcuacuaaaauacauugccaaacucauaggagucucuguagaccaaauccacgguuacaggauagauccuaaugaaaaaccagaaaugcacacuuucgaaguauacagaaaaaugcaaucacuagaaacgauuagaguugaagaauuaccgaggaagguuauagaugaacuugcucacauauuaacauuaaauacagaacgagaaggaauugaagaggccauaaaugcaaaacugaaagauauauuuucucaagaucaaguucuagaauuaguacaauucaggaaaaacaauucuucguuauucaguaaaggguggcauaacuucucacuaaaauuaaugauggaauuaauaccggaacuguacgaaacaucugaggaacagaugacaauacuuacgagacuaggaaaacaaaaaucaaaagaaacguccaaaagaacgaaauacauugaugagaaagaauuaacagaggaaauauauaacccagucguagcaaaaucaguuagacaagccauuaagauaauaaaugaagccacgaaaagauacggaauauuugauaauaucguaauugaaauggcacgagaaaauaaugaagaggacgcaaagaaagaauacauuaaacgacaaaaagccaacuuagacgagaaaaacgcagcuauggaaaaagcagccuuucaauauaacggaaagaaagaauuacccgauaacgucuuccacggccauaaagaguuagcaacaaaaaucagguuauggcaucaacaaggcgaaaaaugccuguauaccgguaaaaacauaccaaucagcgaucuaauacaaaaccgauacaaauacgaaauagaucacauacuaccgcucagccuaucauuugacgacucacuaucaaacaaaguucucguauuagccacugcaaaucaagagaaaggacaaagaacaccguuucaagcacuagacucaauggauuaugcauggagcuauagagaguucaaauccuacguuaaagacucuaaauuauugucgaacaaaaagaaagauuaccuauuaacggaagaagauauaagcaaaauagaagugaaacaaaaauucauugaaagaaaucuaguagacacaagauauuccagcagaguaguacugaaugcacuacaagacuuuuauaaagaacaucaauucgauaccacaauauccguaguaagaggccaauuuaccucucaacuaagaagaaaaugggggauagaaaaaucccgcgagacauaucaccaucacgccgucgacgccuugauaauagcggcaucuucacaacuaagauuauggaagaaacauaauaacccucuaauaaguuacaaagaggaacaauuugucgauucagaaacuggggaaauaaucucaaugucagaugacgaauauaaagaguuaguauucaaagccccauaugaccacuucguagauacacuaaaaucaaagaaauuugaggacuccauacuauucucauaccaaguagacaguaaauacaaucgcaaaauuucagaugcuacaauauacgcaacuagaaaagcaaaacuagauaaagauaaaagugaagaaacauacguacuaggaaaaauaaaagauauauauagucaagccgguuacgauaccuucauaaaaauauacaauaaggauaaguccagauuccuaauguaucacaaagauccgcaaacauucgaaaaagucaucgaagaaauacuuagaaccuauccaucaaaagaacuaaacgagaaaaauaaggaagucccuugcaaccccuucgaaaaauacagacaagaaaacggaccgauaaggaaguauagccgaaaaggaaacggacccgaaaucaaaucacuaaaauauuaugauaauaaacuaggaaaucacauagauauuacacccaaugaaucuaugaaccagguuguccuucaaucuuugaaaccuuggagaacggacguauuuuucaaucaccaaacggaaaaauaugaacuaaugggauuaaaauauagugaccucaauuucgagaaaggaagcggcaaauacucaauaaguuuagaaaaauacaacagcauaaaaaugaaugaaggcgucucagaagaaagugaguucaaauucacauuauauaaaaaugaucuuauacuaauaaaagaugcacucacaaaagaagcacaaauauuuagauacggcagcaggaacgacacauccaaacacuacguugaacuaaagcccuaugauaugucaaaguucgaaggagacgaaagacuaauaaaaguauuaggaacaguagcaaaaggaggaagguguauaaaaggacucaacaagaaagacauaucuauauuuaaagugaaaacggacguacuaggcaauaaacacuuuauaaagaaagaaggcgaagaaccuaaauuaaaauucuga

SEQ ID NO: 5127 - RNA, 3387 nt, Artificial Sequence
  Cas9 variant
augacaaaacuuggcaaaccuuacgggauaggaguugauauaggaucgaacucaauugguuucgcagcaguagacgaaaauucacauuuaauacgucuaaaagguaaaacuguuaucggagcucgauuauucgaagaggguaaagcggcagcaaaacgcagagcagguagaacaaccagaagacgauuaucaagaaaucgcuggcgucucagcuucuuaagagacuuuuucgagucacauaucacuccuacagauccaaacuuuuucaugagacaaaaauauagugagaucagcccaaaagauaaagcacgauacaaauacgaaaaacgacuauuuaaugauagaaccgacgcugaauuuuaucaacaauauagcacuauguaccaccuacgaaaucgacuaaugacagauccuagcagagcagacguacgagagauauacuucgcaauacaucauauacuaaaaaguagaggacauuuucuaacgccuggagaugcaaaagauuucaacacgaacgacguagcacuagaugaaauauuccccgcgcuccaagacgcauaugcacaagucuaucccgaccuagggauuaccuucgacgaggauaaagcuaaugaguucaaaacgauacuguuaaacgaaauagcuacaucaaucgacacccaaagagcuuuaguaaaacugcuucuagcagaagaagaugacaaagauauacuaaaacaacaaaaacaaguucuuacugaguucgcaaaagcuguagucggacuuaaaacaaaacugaaucuugcacucggcacugaaguagacucaucugaagcaacagcauggaauuuuucuuuaggccaauuagacgauaaaugggcuggaauagaaucagcuaugacagacgaaggaaccgaaauauuagaccaaauuagagaccuauacagagccagauuacucaacggaauuguuccaaccggaaaaacauuaagucaagcaaagguagacgauuacacacaacaucacgaagacuuacaacuauuuaaggcauaccuaaaacaacuagaagacgauggcacagcaaaagcuauaaggcaacuauaugauagauauauagacggagaugaugcagcaccguucuuaagagaaaacuucguuaaagcacugaccaaggauguaacugcccacccaaauacaaaaaguccagaacuauuagaaagauuagcucaaccugauuuuaugcuuaaacaaagaaacaaagcgaacggggcaauaccaguccaaaugcaacaaagagaauuagaccaaauaauuaaaaaucaagccguauacuaugacugguuagccgcaccaaauccagucgaaaaacaucgaaaaucuaugccauaucaauuagacgaacuacuaaauuucagaauaccauauuacguuggaccacucguaacagcaaaagaacaaaaggcagcacaaggcggaguauucgcauggaugguaagaaaagauccagaaggaaauauaacaccauauaauuuugacgaaaaaguagaccgagaagccagcgccaacaccuucauccaaagaaugaaaaccacagauacauaccugauaggugaagauguacuaccuaaacaaucucuacucuaucaaagauacgaaguacuuaacgaacuaaacaauguaagaguaaacaaugaaaaauuaaguaucgaacaaaaacaacaaguuauaagagaacuauucgaacgccacaauucuguaacuaucaaacaguucgcagaaaaucucagagcacauggagacuaugcacauauaccagaaauaagagguuuagcagaugaaaaacgauucuuaucaucacucucaacauaucgacaacuaaaaucucugcugccagaagcaauagacgauccugcaaaacaagcggauauugaaaacauaauagcauggucaacaguauucgaagacgcagcuauauuuaaaacgaaauuaaaagaaauaaguuggcuaggaucagaagccauaacaaaauuaagcaauauacguuaucggggauggggucaauuuucccgaaaauuccuuaauggucugacacuaggcaauggacacaccauaauucaagaauuacugcuaagcaccaacaacuuaaugcaaauuuuaacggacgaaacacuacaaaagaaaaugacagaacucaaugcagacaaauuaaaaacagcuaauauaaacgaugcaaucgauaaugccuacacuucacccagcaauaagaaagcacuccgucagguguuacgaguaguagaugauauaaaaagagcagcagauggacaagauccaucauggcuauacguagaaacugcagauggcggcggcacuccugguaaaagaacuagagcaagacaacaccaguuacaagaaauuuacgcaaacgcugcacacgaacuaauugauacagcaguccguggagaacuggaagauaaaaucucggauaaagcagauuucaacgacagauuaguccuauauuucaugcaagggggaagggauaucuacacaggagcgccacuuaacauagaccaacuuucgaguuaugacauugaccacauucuaccacagagcuuaauaaaagacaauagucuagacaaucgaguucuaguacacgccauaauaaauagagagaaaaacgcuacauuugcaaguacaaucuacgcacaaaagaugaacgcaacuuggaggcaauggcaugaagcaggacuaauaaguggaagaaaacuaagaaaucuucaaaugagaccagaccaaauagacaaguaugcaucuggauuuguugcucggcagcuaguagaaaccagacaaauaaucaaacuaacagaacaaauaguagcagcacaauacccugacacuaaaauaauugcuguaaaagccgggcucagccaccaauuaagagaagaauuagaauuucccaaaaacagagacguaaaccacuaccaucaugcauuugacgccuuucuagcagcccgcaucggcacauauuuauuaaaaagauuuccaaaucuccaagcauuuuucacauaugguaaauucacaaaagcagacgucaaaaaguuaagaggguuuaauuucauccgugauauaacacaugcagaagauaaaauaguagcaaaagauacaggugaagucguuugggacaaacaaagagacguagaugaauuagacagaauauacaacuucaagagaaugcuaauaacgcacgaaguaagauucgaaacagcggaucuauucaagcaaacaguauauggagcuagggacucuaaagaagcaggaggcucaaaacaacuaaucccaaagaagaaagauauucaacuaaucuucaugggugcaauaagugagagaacuagaccuauacugccuuuguga

SEQ ID NO: 5128 - RNA, 3387 nt, Artificial Sequence
  Cas9 variant
auggaugaaaaaauggauuauagaauaggccuugacaucggaauagcaucaguaggaugggcaguuuuacaaaacaauagugacgacgaaccaguaagaauaguagauuuaggaguuaggaucuuugauacagcagagauaccuaaaacuggugagucacuagcagggccaagaagagcugcaagaaccacgcgccgaagauuaagaagaagaaaacaccgacuggacagaauaaaauggcucuucgaaaaucaaggucuaauaaauauagaugacuuuuuaaaacgauauaauauggcaggacuaccagacguauaucaauuaagauacgaagcacuagauagaaaacuaaccgacgaagaacuugcacagguauuauugcacauagcuaaacacagaggguuuaggucaacgcgaaaagcagaaacagcagcuaaagaaaacggugcaguauuaaaagcaacagacgaaaaccaaaaaagaaugcaggaaaaaggauauagaacagucggagaaaugauauaucuggacgaagcuuuucgaaucgguugcagcuggagugaaaaagguuacauauuaacuccaaggaacaaagcagaaaacuaucagcacacaaugcugagagcaaugcuaguagaagaaguuaaagaaauauucucuagucaaagaagacuagggaacaaaaaagcaacugaagaacuagaagaaaaauaccucgaaaucaugacaucacaacgaaguuuugaccuaggcccaggaaugcaaccagacggaaaaccgucaccauacgcaauggaagguuuuucagauagaguaggcaaauguaccuucuuaggugaccaaggggaauuaagaggggcaaaaggaacauacacagcagaauacuucguugcgcuucaaaaaauaaaccacaccaaauuagucaaucaagacggagaaacaagaaacuucacagaagaagaaagacgagcgcuuacccuacuacuauuuacccaaaaagaaguuaaguaugcagcaguacggaaaaaacuaggauugccugaggauauacuauucuauaaucuaaacuacaaaaaagcggcaacaaaagaagaacaacaaaaggaaaaucaaaacacagaaaaagcuaaauucauaggaaugccguauuaucacgacuacaaaaaaugccuagaagaaagaguaaaauaccuuacugagaaugaagucagagaccuauuugaugaaauaggcaugauacuaacauguuacaaaaaugacgauucaaggacagaaaggcuagcuaaacuaggucugguaccaauagagauggaaggguuacuagcauauacaccuacaaaauuccaacauuuaagcaugaaagcaaugcgaaauauaauaccauuccuagaaaaaggaaugacauacgauaaagcaugugaggaggcagguuaugauuucaaagcagacucgaagggaacaaagcaaaagcuauuaacaggggaaaauguuaaccaaacaaucaaugaaauaacaaauccaguaguaaaacgaucaguaucucaaacuguaaaaguaauaaacgcaauaauaagaacuuacggaaguccucaagcaaucaauauugaauuggcaagagaaaugucgaagacauucgaagaacgaaggaaaauaaaaggggacauggaaaaaagacaaaaaaacaaugaagacgucaaaaagcagauacaagaacuaggaaaauuaucaccaacaggccaagacaucuugaaauacaggcucuggcaagagcaacaaggaauauguauguauagcggaaagacuauuccguuagaagaauuguucaaaccgggcuaugacauagaucauauacuacccuauuccauaacauuugaugacagcuucagaaauaaaguauuaguaacaagccaagaaaacagacaaaagggaaaccgaacaccauaugaauauaugggaaaugacgaacaaagauggaaugaauuugaaacucgugugaaaacgacaauaagggauuacaagaaacaacagaaauuacuuaaaaaacacuucagcgaagaagaacgaagcgaauucaaagaacgaaauuuaaccgacacuaaauauaucaccacugugauauacaacaugauaagacaaaacuuggaaauggcuccauugaaccgaccagaaaaaaaaaagcaagugagggcugucaauggggcaauaacagcauauuugcgaaaaagguggggacuuccucaaaaaaaccgagaaacagauacacaucaugccauggacgcaguugucauagcuuguugcacagauggaaugauccaaaaaauuaguagauauacaaaaguccgagagcgauguuauucuaaaggaacagaauuuguagaugcugaaacuggcgaaauauuccgaccggaagauuacucuagagcagaaugggacgaaauuuucggagugcauauaccgaaaccaugggaaacauuccgugcugaacuagauguccgaaugggagaugacccaaaaggauuuuuagacacacauucagacguagcccuagaauuagacuacccagaauauauuuacgaaaaucuacgacccauauucguaucaaggaugccaaaucauaaaguaaccggugcugcucaugcagacacaauccgguccccaaggcacuuuaaagaugaagggauuguacucacaaaaacagcauuaacggauuuaaaacuggacaaagacggugagauugauggcuauuacaauccucaaucugaccuacuucuauacgaagcacuuaagaagcaauuacuauuauaugguaacgacgcaaaaaaagcuuucgcucaagacuuucauaaaccuaaagcagacgguaccgaggguccaguuguccguaaagucaaaauucaaaaaaaacaaacgaugggaguauuugucgacaguggaaacggaauagcggaaaauggcgguaugguccguauagacguauuucguguuaauggaaaguauuauuuuguaccuguuuacacagcugaugucguaaaaaaaguuuuaccgaaccgugcgaguacagcaaauaaaccuuauagugaauggagaacaauggaagauaaagauuuccuauucagcuuguauagucgagauuuaguacacauuaaaucaaaaaaaggcauaccuauaaaaaaugucgacggaucucucggagaaaguaaagaaguuuacgccuauuauauaggagcagacaucucuggggcaaaaauagagggaaaagcacaugauaguagauauacauuuagaggaaucggaguacaaaaacucgaauuaauagaaaagugccaaguagauauauuaggacacauaucaacagucaagaacgaaaaacgcaugggcuucucauga

SEQ ID NO: 5129 - RNA, 3387 nt, Artificial Sequence
  Cas9 variant
augaacgauaaaaaucaaaaauauagauuaggucuagauuuagguacaaauuccauaggauggugcauauacucauuagauguaaacaacaaacccgaaacucuuauagacaugggaguucgaauauucagugacggcagagacccaaaaacaaaagaaccacuugcuguagaaagaagaacagcaagagggcuuagaagaauacuucaucgcagaaaacuaaggagaagacaaauguuuagacuuuuacaagaacaaggacucaugcccaaugaugcaagugaagcagcggcauuaaaaucacuaaauccauacgaacuaagaguaaaagcauuggauaccaagcuagaaccauaugaauuaggccgugcuuuauuuaaucucucaguaagaagaggcuuuaaaucaaaucgaaaagaagcgguccaagaaaaagaaaaagacucccaaaacgacgcuaagagucaaaaugaaaaaugcgaacauuuagcaaaagcaaucaaagauaguggguguagaacacuaggcgaguuccuauggaaacauaaaaacacugaaacucaacaaacagaaaaugacgcaagaaacauaggaaugcgcuuuguaccggguagaaguaacuacuaucccacgagacgaauguacguagaagaauuugaugcuauaagaaaagcccaagaacccuacuacucagggguaaacugggacgcucuccacgaaaagcuauuuuaucaacgaccgcuuagagcccaagaacgaggcaaaugcagauauaugccagacaaagagagaacauuuaaagcaaugccaugcucacagaaaauaaggauacugcaagaaguauacaacauggauuauauugacgaauacggaaaaacuauaccuuuagaagaagcacaaacagacagccuuaucagucuucuagacaaaagagaaaaacuauccuucaaagcaaugaagaaagaauuaggaauagacgaaucauguacauuuaaucuggagagaggaggucgagaauacuuacaaggaaacgccgcagccguaaaacuuagaaauaagaaacguuucggagaacuaugggauucacuaagucucgccaaacaagacgcaauaguagaaaaacucauaacagcugaugaagacgccgaaauaauaagcauguuagcacaauacaacuuaacagaugaacaaaagaaaaacauagccguaacuguacugcccucaggaacggccaugcuaugcaaagaagugacagagaugcuuguucaaaagauggaacaaaauaaaauuccacucacaguugcaguacaaaugcugggauacaccuacgcugaucaaucaguaagagaagaagacacauuaccauauuacggagcaauucucaccgggagcacaaugggugcucacccagaagcagacgaaucagaaccggaacuaaaauacggaaaaauaagcaauccuacaguacacguagcacuuaaucaaacuagaacaguuguaaaugcacuaauuaaagcauacggaaaaccacaacaaauaguagucgaacucucaagagauuuaaaagcaucaagggaagcaaaagcaagaauacagaaaacuauaaccaugaaccagaaaaggaacgaaagagacaacaaaaauauaacugauauaacaaaaauccccuacccaaacagaaacgacagacuaaaauaucgacuuugggaagaauugggaucaggaucuaacagcuuuaguagaaaaugccuauauugcggaaaaccgauaucuggaucagaaauuuucacagaaaauauagagauagaacauauuuuacccuucggacgaacacuauucgacggagagacgaacaaaacuguagcacacacugacugcaauagagauaaaggagaccgaucaccauucgaagcauuuggaagcucaccgaauggauacaacuggcaugaaauaugugcacgggcaaacucccuuaaaaacccagcuaaacguacguuauucgccgagaacgccauggaaaaauuugaaaaagacaacucauucauacaacgacaacuaacagauaacgcauaccuaucaagaagcgcacucagguauuuacgaugcauuuguaaagacgucuggucaauaaauggagguaugacuaaacuucuacgcgacaaauggaauauagauuccauauugaaaagaaaaauagaugaucccgaaauagcacauuucgaacuuaaaaaugaccaaauaggucaauacaagaaaaauagguaugaucacagacaccaugccuuagacgcgucaguaauagcauuaauagacagagcuaugguacaagaaaucucacaacuaaacaaaauaagguugaaaaaccgaauagaagcaccacaaaugccaguacuaaggucggaacuuaucgagaaaguaaaacacaucaccguaaguuuuaaaccagaucauggccggcaagguaaacuaucaaaagaaacacuacuaggaaaaauuaaaaagaucgaaaaaguggacauugauagcauacaaaccgacgacauagcuucaaucaaagaugaugcaauaagaacccgauuugaaacaaaaagaagagaauuaggagauauaacaaaagcaaaagcagcauuaaaaacagaauuuccaaaacuugauguauuuaagacauauuauguuucacgcacgcccauagucagucuaacagagaaaaauauaaauucaauaguagaugagaaaauaaaagaaaaacucaaaacuuucauuaaagaacacgccgauuuaucauuugcagaacaacuacaaaaauucucugaaacagaauggauaggcaaaccgucggccgcaggaaaaccagguaagaaauauagaauagagaaagucagaugcauaaacuggggccaaacaccaauaacaauaacaaguagugcaguaccccgguaucuaugcccagaagacuaucucgcugcaguaguuuggcaaauaccgaguaaaaagaaagacacagaacccgaauauaaagcaacauuuuuaagacgagaugaguucgauguaaauaacaaaccaaagaaacuagaaaaaccacacgaugccgcacaauacauaugcauguuauacaaagaugacuaccuugaguucacagaaaguggagcaacacauuuguguagaauagcaggccuaccagcuucacaaaauaauaaaauugauauucguccaauauacgccguaucugacuguaaagauuggauaauagccacaaaugaaaacauguuagaaccauguuggaaaccacaaaaagaagaaaaacgaauaaguguuaauguauuauucggaaagcauaaagcuagauccguaacggugaaccccaucggacgggucuuccgaaaauga

SEQ ID NO: 5130 - RNA, 3387 nt, Artificial Sequence
  Cas9 variant
augucagauuuaguucugggacuggacauaggaauaggaucaguaggagucgguauacucaacaaaguaacaggagaaauaauacacaaaaacucacgaauauuuccggcagcucaagcagaaaauaacguagaaaggagaacaaauagacaagguagaagacuaaccagacgaaagaaacacagaagaguaagacuuaaccaucucuuugaagaauccggacuaauaacggacuucaccaaaguaucaauaaaccuuaacccauaccaauuacgagucaaaggacuaauagacgaauugaguaacgaagaauuauucauagcuuuaaagaacauggugaaacauagggggauaaguuacuuagacgacgcaucagacgaugguaauuccucaguaggagacuaugcacagaucguuaaagaaaauuccaaacaacuagaaacaaaaacaccaggacaaauccaacuagaaagguaucaaaaauauggucaauuaagaggagacuuuaccguagaagaagacggaaagaaacacagacuuauaaauguguucccuaccagugcauacagaucugaagcauuaaggauacugcaaacacagaaagaauuuaauccucaaaucacagacgaguucauaaaucgauaccuagaaauuuuaaccggaaaacgcaaauacuaccacggaccaggaaacgaaaaauccagaaccgauuauggacgauauacaacaaagaaagauucagaaaaugaauauauaacucucgauaacauauucgguauacuaaucggcaaaugcacauuuuacccugaagaauauagagcagcaaaagccucuuauacagcacaagaguucaacuugcuaaacgauuuaaacaaccucacagucccaacagaaaccaagaaacuaagcgaagaacagaaaaaucaaauaauaaauuauguuaaaaaugaaaaagcaaugggccccgcaaaauuauucaaauacauagcaaaauuacuuaguugcgacguagcagacauaaaagguuauagaauagacaaauccgacaaagccgaaauccacaccuucgaagcauacagaaaaaugaaaacucuagaaaccauagacuucgaaaagaugagucgcgaucaauuagauaaauuagcauacguacuaacucuaaauacagaaagagaaggaauccaagaagccuuagaccacgaauuugcagauggaaacuucucacaagaacaaauagacgagcuaguccaauuccggaaagccaauucuuccauauucggcaaaggauggcauaacuucucuguaaaauugaugauggaacuuauuccagaacuauacgcaacaucagaggaacaaaugacaauacucacaagauuaggaaaacaaaagacaacuucuucaucaaacaaaaccaaauacauugaugaaaaacuuuuaacagaagaaauuuacaaccccguaguggcaaaaucuguaagacaagcuauaaaaauaguaaaugcagcaauaaaagaauauggugacuuugacaacauagucauagagauggccagagaaacuaacgaagaugacgaaaagaaagccauacagaaaauacaaaaagccaacaaagaugagaaagacgcagccaugcuaaaagcagcgaaccaauacaauggacgagcugaacuaccacauucaguauuucacggacauaaacaauuagcuacaaaaauaagguuauggcaucaacaaggagaacgaugcuuauauaccgguaaaacuauuaguauucaugaccuaauaaauaacccgaaccaauucgaaauagaccauauauuaccuuuaagcauaacauuugacgauucacucgcuaacaaaguccuuguauacgcaacagcaaaucaagaaaaaggucaaagaacaccauaccaagcauuggacuccauggaugaugcuugguccuuucgcgaguuaaaggcuuucguaagagaaagcaaaagccucagcaauaaaaagaaagaauaucuauuaacagaagaggacaucucaagauucgacguacgaaagaaauucauagagaggaaccuaguagacacaagauacgcgucacgaguuguauuaaaugcacuacaagaacauuuccgcgcacacaaaacggacacaaaagucuccguugucagaggacaauucacaagccaacugcgaagacacuggggaauagagaaaaccagagauacuuaucaccaucaugcagucgacgccuuaaucauagcagcuagcucacaauuaaaccuuuggaagaaacagaaaaauacucuaguaaacuauagugaaaaucaacuacuagauaucgaaacaggagaauuaauaucagaugaugaauacaaagaaucaguauucaaagcaccauaucaacauuuuguagauacacuaaaauccaaagaguucgaagauagcauacuauucucauaucaaguagacucaaaauuuaaccgaaaaauaagugaugcuacaaucuacgcaaccagacaagcaaaaguaggaaaagacaagaaagacgaaacauauguauuaggaaaaaucaaagacauauacucacaaacaggauacgaugcauuuaucaaaaucuaccaaaaagauaaaucaaaauuuuuaauguaccgccacgacccacaaacuuuugaaaaaguuauagaaccaauacuagaaaauuauccaaauaaagaaaugaacgaaaaaggcaaagaaguccccugcaacccauucuuaaaauauaaggaagaacacggagacuauauucgaaaauacagcaagaaaggaaacggacccgaaaucaaaucccuaaaauacuaugauaguaaauuaggaaaccauauugacauuacucccaaagacucaaacaauaaggucgugcuucaaucagugagcccauggagagcagacguauacuucaacaagacaacagguaaauacgaaauauuaggauuaaaauacgcagaucuucaauucgaaaaaggaacaggaacauauaagauaagccaagaaaaauacaauguaauuaagaagaaagaaggagucgacucagacucugaauuuaaauuuacacucuauaaaaacgaucucuuauuaauaaaagacaccgaaacaaaagaacaacaauuauuuagauuccuaucaagaaccaaacccaacguuaaacacuauguagaauuaaaaccuuacgacaagcaaaaauucgaaggcaacgaaagccucauaaauguguuaggagcaguagccaaaggcggccaaugucaaaaagguauaaacaaaccaaacauuagcauauacaagguaaggacugacguccuaggaaaccaacauauaaucaaaaacgaaggagauaaaccuaaacuggauuucuga

SEQ ID NO: 5131 - RNA, 3387 nt, Artificial Sequence
  Cas9 variant
auggaugagaaaauggacuauaggaucggacuagauaucggaauugcuagcgugggaugggccguccuacaaaauaauucagaugaugaaccugucagaauaguggaucuaggaguuaggauauucgauacagcggaaauaccaaaaacuggugaaucacuugccggaccccgaagggcugcaaggaccacacgaaggagacuaagaagaagaaaacauagacuugaccggaucaaaugguuauucgaaaaccaaggacuaaucaacauugaugacuuccuaaaaagauacaauauggcaggccuuccagauguauaucaacuaagguacgaagccuuagaucgaaaauuaacagacgaagaacuagcacaaguuuuacuacauaucgcaaaacaccgaggauuuaggagcacacgcaaagcagaaacagcagcuaaagaaaauggagcgguguugaaagcaaccgaugaaaaccagaaaagaaugcaagaaaaaggauauaggacaguaggugaaaugauuuacuuagacgaagccuuuaggacaggaugcucauggucggaaaaagguuauauucuaaccccaagaaauaaagccgaaaauuaccaacacaccaugcuaagggcuaugcuagucgaagaaguaaaagagauauucagcucacaaaggagacuagguaaugaaaaagcgacagaagaauuagaggagaaauaucuugaaauaaugacaucacaaaggaguuuugauuuggguccagggaugcagccagacgggaaaccgagcccauacgcgauggaaggguuuagugacaggguuggaaaaugcacauuucuaggagaccaaggggaauuaagaggagcaaaaggaacuuacacagcugaguacuuuguagcauuacagaaaauaaaccauacaaaacuugucaaccaagauggagaaacaagaaauuucacagaagaagaaagaagggcguuaacauuacuguuauucacacaaaaagaagugaaauacgccgcugugagaaagaaauuggggcuaccugaagauauauuauuuuacaaccuaaauuacaagaaagccgccacgaaagaagaacaacagaaagaaaaucaaaacacugaaaaagcuaaauucauaggaaugccauauuaucacgauuacaagaaaugcuuagaagaaagaguaaaauaucuaaccgagaaugaaguaagagaucucuuugaugaaauaggaacaauccucacauguuauaaaaacgaugauucgagaacugaaagauuagcaaaacuuggucuaguuccaauugagauggaaggauuacuagcauacacaccaacaaaauuccaacauuuguccaugaaagcuaugagaaauauaauaccuuucuuggaaaaaggaaugacauaugacaaagcaugcgaagaggcaggcuacgauuuuaaagcagauuccaaaggaauaaaacagaaacucuuaaccggggaaaaagugaaccaaacgauaaaugaaauaacaaacccaguugucaaaagaucaguaucccaaaccgucaaaguuauaaaugcuauaauaagaacguacggaagcccgcaagcaauuaauauagagcuagcaagagaaaugucaaaaacuuuugaagaaaggcgaaaaauaaaaggcgacauggaaaaacggcagaaaaacaaugaagauguaaagaaacaaauacaggaauuaggaaaauuaucaccuacuggucaagauauacucaaauacagacucuggcaagaacaacagggaauuuguauguauucagguaaaacuauaccacuagaggaacuauuuaaaccugguuacgacauagaccacaucuuaccauauucaauaacuuucgacgauaguuuuagaaacaaaguacuugugacaagucaagaaaacaggcaaaaaggaaauagaacaccauaugaauauaugggaaacgaugagcaacgauggaacgaauuugaaacaaggguaaaaacaacaauaagagauuauaagaaacaacaaaaacuacuuaagaaacauuuuucagaagaagaacgcuccgaguucaaagaaagaaaccugacugauacuaaauacaucacaaccguaauauauaacaugauaaggcagaacuuagaaauggcaccauuaaacagaccugagaaaaagaaacaagucagagcagucaauggcgcaaucaccgcuuaccuacgaaaaagguggggccucccacagaaaaacagagaaacagacacacaccaugcuauggaugcgguaguuauagcauguuguacagaugguaugauacagaaaauaagcagauauacaaaaguuagagaaagauguuauagcaaagguacagaauuuguagaugcggaaacaggcgaaauauuucgccccgaagauuacagcagagcagaaugggaugaaauuuucggcguacauauaccaaaaccuugggaaacauuuagggcagaguuagauguaaggaugggugacgauccaaaaggauuucuagacacacacagcgauguugcacuagagcuagacuauccagaauauauauaugaaaacuuacgaccaauauucgugucaagaaugccaaaccacaaaguaacuggugcagcacaugcagauacuauacguagcccacgucauuuuaaagacgaagguauaguacugacaaaaacagcguuaacagauuugaaacuggauaaagauggggaaauagacgguuacuauaacccgcaaucagacuuacuucuuuaugaggcauuaaagaaacaauugcuauuauaugggaaugacgcaaagaaagcauuugcacaagauuuucacaaaccgaaagcagauggaacagaaggcccaguaguacguaaaguuaaaauacagaagaaacaaaccaugggaguguuuguugacagcggaaauggcaucgcugaaaacggaggaauggugagaauagaugucuuccaugugaacgguaaauacuacuuugugccaguauacacagcagacgucguaaagaaaguacuuccuaauagagccgcuacagcacauaaaccauauggagaauggaaaguaauggaagacaaagauuuucuuuuuagucuauacagccgagacuuaauacauauaaaaagcaagaaagacaucccgauaaaaauggucaacggugguauggaggguaucaaagaaacuuacgcguauuauauuggcgccgauauaucagcugcaaauauucaagggauagcacaugacucuagauauaaauucagaggccuugggauucaaagccuagauguuuuagaaaaaugucaaauugacguacuuggacacguuuccguaguaaggagugagaaaagaaugggauuuucauga

SEQ ID NO: 5132 - RNA, 3387 nt, Artificial Sequence
  Cas9 variant
augucagaccuaguccuuggucucgauauaggaauaggaagcguugguguagguaucuugaacaaagucacuggagaaaucguucauaaaaacgcaagaauauucccggccgcacaagcagaaaauaauguagaaagaaggaccaaucgacaaggaagacguuuaacgcgaagaaagaaacauagaagaguacguuuaaaucauaucuucgaggaaaguggauuaauuacagacuuuacaaaaguuucaauaaaccuaaauccauaccaauuacgagucaaaggccuaacagacgaacuaucuaaugaagaauuauucauagcucugaaaaauaugguaaaacaucgaggaauaucuuaucuugaugaugcaucagaugauggaaauagcagcguaggagauuaugcccaaauuguuaaagaaaauaguaaacaguuagaaaccaaaacaccaggccaaauacaacuagaacgauaccagaaauauggucaacuacgaggggauuuuaccaucgaagaagacggaaagaaacauagauuaauaaauguauucccaacgucagcauaucgggcagaagcauuaaggauacuacaaacacagcaagaguucaauccucaaauaacagacgaguucauaaacaguuacuugcagauccuaaccggcaaaagaaaauauuaccauggcccuggcaaugaaaaauccagaacugauuacggacgauacaccaccaagaaagacagcgaagacgaauauaucacucuggacaacauuuucggcauacucauaggcaaauguacauuuuauccagaagaauaccgagcagcuaaagcaaguuauacggcacaagaguucaaucuccuaaacgauuuaaacaaccucaccguaccaacagaaacgaagaaacuauccgaagaacagaaaaaucaaaucauaacauauguuaaaaacgaaaaagcaaugggcccagcaaaacucuucaaauauauugcaaaacucuuagccugcgacguagcagacaucaaaggauaccguauagauaaaucagacaaaccagaaauacacacauuugaagccuacagaaaaaugaaaacccucgaaaccauagaugucgaacaaauggaacgagaaaaacuagacaaacuagcauacguuuuaacacuaaacacugaacgagaagguauucaagaagccauagaacacgaguucucggacggaacauuuucacaagaacaagucgacgaauuagugcaauuucgaaaaucaaauagcuccauuuuuggaaaaggauggcauaacuuuucaguaaaauuaaugauggaauuaauaccagaacuauaugcuacaucggaagaacaaaugacaauucuaacaagacuuggaaaacaaaaacgaaccaguucaucaaacaaaacuaaauacauugaugagaaaagguuaacagaagaaauauacaauccaguaguugcaaaaucuguaagacaagcaauaaaaaucguuaaugcagcaauuaaagaauauggagacuucgauaacauaguaaucgaaauggcacgcgaaaugaacgaagacgaugaaaagaaagccaucaagaaaauacaagaagccaauaaaucagaaaaagacgcagcuaugaggaaagcagcaaaccaauauaauggaaaagcagaacuaccacauuccguauuccauggccacaaacaauuagcaacgaaaaucagauuauggcaccaacaaggagaacgaugccuuuacacgggaaaaacgaucaguauacacgaccuaauaaacaauccaaaucaauuugaaauagaccacauccuacccuuaucaauuacauuugaugauagucuugccaauaaaguauuaguauaugcaacagcaaaucaagaaaaaggacaaagaaccccuuaucaagcauuagacuccauggacgacgcauggucauucagagaacuaaaagcauucguaagggaaucaaaaaccuuaaguaacaaaaagaaagaauaccucuugacggaagaagacauaucaaaauucgacguccgaaagaaauucauagaaagaaaccuaguugauacccgauacgccucacgaguaguacuuaaugcacuacaagaacacuuuagagcaagaaaaauugacacaaaaguuagcguggucagaggacaauucacaagucaauuaagaagacauuggggcaucgacaaaacucgcgauacauaccaucaccacgccgucgacgcgcuaauaaucgccgcaucuucacagcuaaacuuauggaagaaacagaaaaacaccuuaguuucuuacagugaagaucaauuguuagauauugaaacuggagaacuuauuagcgaugacgaauacaaagaaucaguuuuuaaagcuccuuaucaacauuucguagacacauuaaaaaguaaagaauuugaggacaguauccuauucagcuaccaagucgauagcaaauuuaauaggaaaauaagugacgcuacgauauacgcuacuagacaagcaaaaguaggaaaagacaagaaagacgagacguauguguuggguaaaaucaaagauauuuacucacaagcgggauacgaugcauuuauuaaaauauaccaaaaagauaaauccaaauuucuaauguaccgacaugauccccaaacauucgaaaaaguaauagaaccuauauuagaaaauuacccaaacaaagaaaugaaugaaaaagggaaagaagucccauguaaucccuuccuuaaauacaaagaagaacacggggacuauauccgaaaauauagcaagaaaggaaacggaccagaaaucaaaucccuaaaauacuaugauaguaaauugggaaaccacauagacaucacacccaaaaauaguaauaauaaaguagucuugcaaaguguaucuccauggagagcagacgucuacuuuaacaaaacaacugguaaauacgaaaucuuaggacucaaauacgcagaccuccaauuugaaaaaggaacgggaacauauaaaauaagucaagaaaaauauaacgauaucaaaaagaaagaaggaguagacagcgauucagaguucaaauuuacccuguacaaaaacgaccuuuuauuaauaaaagacacagaaacgaaagaacaacaacuauucagauuucucucucgcucaaugcccaauaagaaacauuauguagaacuaaaaccauacuccaaagacaaauucgagaaaaacgaaacacucauagaaauccugggacccacagacaaaagugggaggugcaucaaaggacuugccaaauccaacuuaucaaucuucaaaguaagaacggauaucuuaggcaaccaacauaucauuaaaaacgaaggugacaaaccaaaacuugacuuuuga

SEQ ID NO: 5133 - RNA, 3387 nt, Artificial Sequence
  Cas9 variant
augacaaaaauccucggucuagauuuagguacaaacuccaucgggugggccgucguugacgaaaaaaaagaaaaaauauuagggaugggcucaagaauauucccggaaggaguuguaaacauaggagaaggagaaggccgugaaacuagcaaaaacgcaaguagaacagacgcgagaggcacacgcagacaauucuuuaggcgaaggcuucguaaacgauacuuauuacgugaacuagcaaaaaaaggacuauguccaaucaacuacacucuaguuaaagaguggaacgaagcucaaauauucaaaaacaaacaauuacaagaaugguuuaaacuuaauccauacgaauuacguucaaaagcaauacaagaaaaaauaucauuggaagaauuaggaaggaucuucuaucauuucauacaaagaagagguuuccagucuaacagccgaagcgcaggcguagacaacauagaaaaaucagucaucuuuaaaggugacacgaaaacgggcaaaauaggaauauccgaaacauuagaaaguauaaaaaacacaaaaacacuaggauccuacuuacacacuauauauccaaaacaaaacaaaccauauaguggccacaaagaacgcauaagaaacagguacacaacacgccaaauguacaucuacgaauuugaaacuauaugggaauaucaaaaacaguucuacagugaacuaucaaacgaacuaaaaacaguacuagguggucgcaaaaaagacggauacaaagaggauggaauacucuuccaucaaaggccccuaagaucacaaaaacaucugguaggauacugcaguuuugagccaaaaaaaacaaaaugucaaauaaauacaauaccauucgaacuauuucgcauauaucaaugggugaauacagucgauugcaacgaaaaaguaaccucagaagaucgaggaaaaaugguagaacuucuauuaagcaaggaaaaaguaucauucaaagaaauaagaaaaguaauaaauaaaucagauggauacuaucaauuuaauuacaaaaaugacgacaaaauaguagggucauacacaauuucaaaucuaaguaauaaaaaguuuuuuggaaaaaagugguuugauuucagcgacaaagaacaagaagauauauggcacguacuuucuuucuucgacgauagagauaaacucaaacaauacgcaauuaaauauugggguuuuaaugaagaaaaagcuguaaaaauaagcaaauuuaacuuaaaagagggauacucaaacuuaucacgcaaggcaauccauaacauccucccauuccuaaaacuaggauucauguaugacgucgcagucggacucggaggcguaaagaaugcccucgccgacaaauggauagaaaacgaacaguuuauuuuagacaacguaccuaguguaguccguagcaauuucaaggguggcuacauagaaccauuaaaacaaaugcugaaauacgaauuugacgucucagauaaacaacuacuaaaacuauaccaccacagcagugcaauugaaaccacggaauuguuaaaaaaauuaccuaucaacuccgaagccgacaaagaaauucaaagcaucaaaaauccaguaguaauaaccgcauuauucgaaauaagaaaauugguuaaugagauaauagauacguacggaaaauuugaugaaaucaaagucgaacucgcaagagauuuaaaagcuucaaaaagcaaacgcuacgacacaagaagggaacaauuaagacuagaaaaagaaaaugaccggauuaaaauagaacucgaaaacuuaggacaaagaauaaaucacauaacaauccuaaaauacaaacuaugggaagaaugcgacaaaagauguccauuuacaggaaaaaauaucgaaguuaacgaacuguucagcggagaaguacaaauagaacacauauuccccuggucgagaucuuuaaaugauaguuuuaugaauaaaacacucuguuucgccgaugaaaaccgagcaaaggggaauaaaacccccuaugaauuuuauagugaacaaggagaacaaaaaugggaagaaauaaaaauucaagcccuaaguugcuucaaaaauaaaccgaacuaucccaacgccuaucaaaaauuuaaacaguucguaaaaaaaaaacaugaugaagacuuuauaagcagacaacucaacgacacucgauauauaagcaaagaagcaaaaaauuaucucucgaaaauaugcaacaacguacaaguagcacccggacaaaugacagcaacucuaagacauaaauggggacuaaacacaauuuuaaacaaagaugaugacacuaaaacaagagacgaccauagacaccacgcaauugacgcacuuguuauggcgugcaguacaagaucucaucuacaggaacucaguaaacguaauagguaucaaaaagacuacgaauucaaagauuuccccaugccuuggcaauucuuuagacaagacgcagagaaaucaguagaacaaauauugguaucgcauaaaaaacuuaauacaaucuuaacgguacgaacacacaaaacgaaaaaaaacggaguagucuacaaaaauauaggaguagccgcccgaggucaacuacauaaagaaacgguauucggaaaaagaacagcuccagaugguauagaagcauaucacguacgcaaaccaauagaaucgcuauccacacacaaacauauaaacaaaguugucgacgaaacaauuagauuacuaauucuuaaacaaguuaacaaacugggcggauucguaaaagguaaaaucccugagggaaccuuuuauaacacagaugaaaacggaaacaaacaaccacaaaucuuccuaccuaacaaaaauggaaaucccguaccaauaaaaaaaauacguuuacgagaaaacauaggaggagcagaacaacuaaaaagcacagucaaccaacacguaaauccuagaaguaaccaccacguacuaaucuacaaagauuuugacgauaaccuuaaagaaaagguggucacauucuggacagcggucgaacgaaagaaacaaaaacaagcaguauuccaauuaccugaaaaugggaaagaaauuguuacuacuuuacaaauaaaugacauguuuuuauuaggcuugaaagacgaugaaauaaacugggaacacccaaaauucaccuuacucaaagaacauuuauaucgaguacaaaaauucacgucaggcgacuacuacuuccgcaaacacauagagagcaaucuaaauggagagcuagguaaagcuuaccaauacaucaaaggauucggugaaggaaaaaccggauggaaaacauuuaauccaaucaaaauaaaaguuucaguuucaggaaaaauagaaaaaguauga

SEQ ID NO: 5134 - RNA, 3390 nt, Artificial Sequence
  Cas9 variant
augaauggacugguauuaggacuagauaucggaauagcauccgucggugcaggaauacuaaagaaagacacaggcgaaaucauucacgcaaauaguagauuauucccagccgcaaccgcagauaauaacgucuuaaggagaucaucaaggcaagcucgacguagcacucgacgaaaaagacauagagcugucagacuacacgaucuauuugaagauuacggguuacugaccgauuucagcaaagugucaauaaaucugaauccauacaaacuacgaguagagggaauggacauccaauuaacuaccgaagaauuauuuauagcacuuaaaaauauuauaaaaagaagaggaauaaguuaucucgacgaugccagugaggacgggguaacaguuucaucagacuacggaaaagcaguagaagaaaacagaaaauuauuaagcgaacagacaccaggucaaauacaacuugaaagauucgagaaauauggacaaguaagaggcgacuucacaguagaagaaaacggcgaaaagagacgacuaauuaacguauuuaguacaucaacauauagaaaagaagcagaacgaauauuacgaaaacaacaagaguucaacaauaaaauaacagacgauuuuauagacgacuacuuaacaaucuuaaccggaaaacgaaaauauuaucacggcccaggaaacaagaaaucuagaacagauuacgggagauauacaacaaagaaagauagcgaagguaaauacauaacccucgacaacaucuucggaguacuaauuggaaaaugcacauuuuauccagaugaauauagggcuucaaaagccucauacacagcucaggaguucaaccuccuaaaugaccugaauaaccuaacaguaccaacugaaacaaagaaacucucagaaaaacagaagaaaacaauagucgaauacgcaaaaacggcaaaaacacuaggggcauccacacuacuaaaauacauagcaaaaaugguagacgcaagcguagaccaaauccauggauaucgagucgacguaaacaagaaaccggaaaugcacaccuuugacguauacaggaaaaugcaaagccuagaaaccuucaacguaaaugaaaugccaagagaaguacuagacgaacuagcacauauauuaacucugaacacagaaagagaaggcauugaagaagcaaucaacacaaaauuaaaagggaccuuuaaccaagaucaaguauuagaauuaguccaauuccgcaaaaacaauaguagcuuauuuagcaaaggauggcacaacuucucauuaaaacuaaugauggaacuaauuccagaauuauacgcgacuucugaagaacaaaugacaauauuaacaagacuagguaaacaaaaauccaaagagauuagcaaaagaacuaaauacauugaugaaaaagaaauuacagaagaaauuuauaauccaguagucgcgaaaagcguacgacaagcuauaaaaaucauuaacgaagcaacaaaacaauauggcauauuugaucauauaguuauugaaauggcaagacuaacaaaugaagaggacgcaaagaaagacuauauuaaaagacaaaaagcaaaucuugaugagaaaaaugccgcaauggaaaaagcagcuuuucaguacaacgguaagaaagaacugccagauuccauauuccauggacauaaagaacucgcuacgaaaaucagacuauggcaccagcaaggcgaaaaaugccuauacacgggcaaaaacauacccauaagugacuuaauacaaaaccaauauaaauacgaaauugaccacauacuaccauuaucacucagcuuugacgacucuuuaaguaacaaaguauuaguccuagccacugccaaccaagaaaaaggacagagaacaccuuuucaagcacucgauagaauggacgacgcuuggagcuauagagaauuuaaaagcuacgucaaagauucaaaauuacuaggcaauaaaaagaaagacuaucuccuuacagaagaagacauaucaaaaaucgaaguuaaacaaaaauuuaucgaaagaaauuuaguugacacuagauauucaucaagaguaguauuaaacgcauuacaagauuucuacaaaaaucaucauuucgauacaaccaucuccguaguucgaggacaauuuacaagucagcuacgacgaaaauggggacuagaaaaaucaagagaaacuuaccaccaccacgccguagaugcauuaauuauagcugcaucaucacaauuacgacuuuggaagaaacaaaacaauccacuaauauucuacaaagaaggacaauucgucgauucagaaacaggggagauacucucacuaaaugaugaugaauauaaagaauugguauucaaagcuccauacgaccauuuuguagauacccuaagaucgaaaacauucgaggauucaauccuauuuucauaccagguugacaguaaauacaauagaaaaauauccgacgcaacaauauacgcuaccaggaaagcaaaauuagauaaagacaaaagcaaagaaacauacguacuuucaaaaauaaaagauaucuacucacaagcugguuacgacgcauucauaaaaauauauaauaaagacaaaucaaaauuucuaauguaucacaaagauucacaaacauuugaaaaaguaaucgaagaaauucuacggacuuaccccaguaaagaguucaacgauaaaaacaaagaaguaccauguaaucccuucgaaaaauauagacaagaaaacggcccuauaagaaaauacucaaagaaaggaaauggacccgaaaucaaaagccuaaaauauuaugacaaaaauauuccagaaucauucauaaauaucacaccaaguaauucuaaaaauaaagugauauugaggcaauuaaacccguggagaacagacgucuacuucaaccaucaaaccgaaaaauacgaauugcuaggacucaaguacgccgaucuucaauuugaaaagaaaacagggacauauucgauaacuauagacaaauacaacgaaauaaaggaaaaagaagggguaggagaacaaagugaauuuaaguuuacuuuauauaaaaaugaucuucuacuuauuaaagacacaaagaacaacgaaaaacaaaucuuucgauuucuaagucgaaccaugccuaacguaaaacauuacguagaacuuaaacccuacaacaaagccaaauuugacggaaaucaaccacuuaucacuauauuuggaaauguugcuaaagguggacaaugucuaaaaggacuaaacaagcccaacauuaguauauauaaaauuaaaacugauguauuagguaauaaauauuucaucaagaaagaaggggacaaaccaaaacucaaauucuga

SEQ ID NO: 5135 - RNA, 3390 nt, Artificial Sequence
  Cas9 variant
auggcggacaggauaucacuaggauuagacauagggguagcuagugugggauuuucaguacuggacauagauaaaggcaaaguuaucgaguuagggagcagauuauuuaacgccacuguugcagaaggaaaucaagauagaagaagcaugagaggagcaagaagacuacucaacagaaacaaacagagaagacaagauacaggaaaauuauuccaaaaauuuggcuuauuagacaauuucaacaaagacaauuucuacgauaccuucaaucaaaauuggaauccuuaugaauuaagagucaaaggccuaacagaacauuuaacaaaaaaggaacuggcugaaagcuuauaccagaucguaaaacaccgcgggauaaguuaugcccugaaagaugcagacgcugaugaaggaggaacagauuacagugcaucacucaaaauaaacagucaagaacuagcagaaaaaacaccagcucaaauccaauuacaaagguuaaaugauuauggaaaaguaaggggacagguagucauaggcgaugauccagauaaucaaaaaguacuauuaaacguauucccaacaucagcauaugaaaaagaagcaaaacagauaauagcaacacaaaaacaguucuauccagaaauacuaaccgaugaauucacgaaagaauacuguaaaauauuaacuagaaaacgugauuacuucguagggccaggcaacgaaaaaucacgcaccgauuauggaauauacaaaacagauggacgaacauuagauaacuuguucgaagaacuuauaggccaugacaaaauuuaucccgacgaauuaagagcaucagcagcgucauauaccgcucaauuauuuaacgugcuaaaugaccugaacaaucuacggauauuaaguuaugaagauggaaaacuaacuaaagaggacaaagaaaaaauaauagcagaaauaaaaucaaacaccacuacaauuaacaugcuaaacgugauaaaaaaagucgcugguuguagcaaagaagacauaaaaggauucagaguaaaugaaaaagauaaaccagaaauuagcucgauggccguguauagaaaaguccacaaagaucugcucaaaguaggaguagacauauccgauuggccaguugaauucauugacaaacuaaguuuuauuuuaacacuaaacacugaaaacggcgaaauaagaaagcaguuaaauaaucgucuaguaccagaauuugauuuucuaaaugacgacuuaauccaacuaauuauugauaacaaagacagcuucgaaauaaaaacuaacaauaaauggcauagauucucccuaaaaaccaugaacaaguuaaugccagaaaugcuggaacgcccagucgaacaaaugacacuauuaaaugaaaugggacuuguaaaaaaagacaaaaaaagauucgaaaacaauaaauaucuaccauauaaagagauagcaaaagauauauucaacccagucgcuucaaagucaguaagagaagcacuaaaaauaguuaacgcaguacuaaaaaaauaugggcauaucgacuaucuaguaauagaaaugccaagagauaaaaaucuaaaagaagaacaagacaacauaaaagaauuccaaaacaaaaauaaaaaagccaaggaugcagccuuugaagcauuugucaaaagcguaggcucagaacaacgcgugaaagaggcuuuaucaaaaaacagaaaauugcaaaugaaaaugcgacugugguaccaacaacaggagauugauccuuacaacggagaaacaauugacgccacagaccuaauaaacaauccagacaaguuugaaauagaccacauaaucccacaaaguaucagcuuugacgauagcauuaauaauaaaacacuauguuuugcaucaaugaaccaaguaaaaggccaaaaaacuccguacgaguucaugcuugaaggacauggucaaggauaugacaaauucaaagccacuguacuagauaauaaaaauuucgacaggaauaaacgaaaaaauuaucuuuuugaagaaaacgucagugacauagaaacgagaaaaagauuucuuagcagaaaccuaguggauacgagauacaguucucguguagucuuaaacagucuccaagacuucuuccacgaaaaaagcgcagacacaaaaguaacaguaauaagagguaaauucaccucuaauaugcgcaaacacuggcauauagacaaaacaagggaaacauuucaccaucaugcgauagacgccagcaucauagcagccacacccuuccuuagaauguggaagaaagguggaacuauauuuccgguuaagguaggagaagaaagcauagacauagaaacaggagaaauacuagaugauaaaaaauuugauaaaguuauguaugaagaaccauacaacggauuuguaucagaaaucaugaaugccgacgaccggauaaaauuuagucaccaaguagacaaaaaaaugaaccgaaaagucagugaugcuacuauauauagcacccgaacaggaaaacuggcaaaagauaaaaaagacgcagaauacauaguagcaaagguuaaagauauauauagcguagacggguuuaaaaaauucaaaaaagucuaugacaaagauaaaaguaaauuucuccuauacaaauaugacccgagaacauucuccgaacuagaaaggauuauaucagauugcccugauaaaguagagaaaguacaaacaaauggaaaagugaaagccguagacguaaguccauucgaaauguauagaagguaccacggcaugauaaaaaaauauaguaaaaaaggaaauggaccugccauuaaacaacuaaaauacuuagacaagaaauuagguucgcauauagacauaacacccgccaaugcaaauggcaaacacguaauauugcaaucacuaaaacccuggcguacugauguauacuuaaaucaugaaaccggagaauacgaaauaaugggaauuaaauacuccgauuuaaaguucaacaaaaauguuggauaugguauaaagaaagauaaauaucuagaaauaaaaaaaaacgaagaaguaagugaaaaaagcgaauucauguucucacuuuaccgaaaagaucgcguucgaauccaaaacaugaaaaccggagaaaguguagaauuacuguucuggucaagaaacuuuucgaacaaaaaauaugccgaacuaaagccaauauuuaaauuugucacagaagacgacgauuggccaguuuacggacaugcgaaaacucaaauauuaaaacgacugguacccaaagacuguaaaauauggaagguaaacaccacaauacuaggagaccccuacuauuuagaaaaagaauccgacaacccaaaagauauauuagacuga

SEQ ID NO: 5136 - RNA, 3390 nt, Artificial Sequence
  Cas9 variant
augacaaacggcaaaauccuuggucucgauaucggaaucgcuagcgugggaguggguaucaucgaggcaaaaacuggaaaaguuguacaugcaaauagccgccuauucagcgcagcaaacgccgaaaacaacgccgaaagaagaggauuccgagguucaaggagacucaauagacgcaagaaacacagaguaaaaagagucagagaucuauucgaaaaauauggaauaguaacagauuuccguaaccuaaaucuaaauccuuaugaauuacgaguuaaaggauuaacggaacaacuaacaaacgaagaauuguucgcagcuuugcgaacuauaaguaaaaggcgaggaauaaguuaucuagaugaugcagaagacgacagcacaggaucgacagauuaugccaaaagcauagaugaaaaccgacgguuguuaaaaacgaaaacaccaggacaaauccaacuugaaagacuagaaaaauauggacaacuccguggaaacuucaccguauacgaugaaaacggugaagcacauagauuaauaaacguguuuucaacaagugacuacgaaaaagaggcgcgaaaaauauuagaaacucaagcagacuacaauaagaaaaucacugcagaauuuauagacgauuauguugaaauacuuacucaaaaacguaaauauuaucauggaccgggcaacgaaaaaucaagaacagauuacggacgguuuagaacagaugguacaacccucgagaauauauuuggaauauuaauaggaaaauguaguuucuacccugaugaauaccgggcaucgaaagcaaguuauacugcgcaagaauacaauuuucuaaaugaucuaaauaacuuaaaaguaccaacggaaacaggaaaacucagcacagaacaaaaagaagcguuaguagaauuugcaaaaucaacagcaacccuuggaccagcaaaacuauuaaaagaaaucgcaaaaauuuuagacuguaaaguagacgagauaaaaggauaucgagaagacgauaaaggaaaaccagauuuacauacuuuugaaccauauagaaaacuaaaauuuaaccuagauaguguaaacauagacgaucugucucgagaaguacuagacaaauuggcagacauauuaacacuaaacacagaaagggaaggaaucgaagaugcuaucaaaagaaauuuaccaaaccaauucacagaagaacagauuucagaaauaauaaauguaagaaaaucgcagucuacagccuucaacaaaggguggcacagcuuuuccgccaaacucaugaacgaacuaauuccggaauuauaugccaccucagaugaacaaaugacaauauuaacuagauuagagaaauucaaagucaaaaagaaaaguagcaaaaauauuaaaacuauagacgaaaaagaaaucacagacgaaauauacaaucccguagucgcaaaaucaguccgacaaacgauaaaaauuauaaacgcugcaguaaagaaauacggagacuuugauaaaauaguaauagaaaugccgcgugauaaaaaugcagacgacgagaagaaauucaucgacaaaagaaacaaagaaaacaagaaagaaaaagaugacgcauuaaaaagggcggcauaucuuuauaaugguacagacaaacuuccugacgaaguauuucacgaaaacaaacaacuggagacaaaaauacgacuuugguaucaacaaggagaaagaugucuauauuccggaaaacccauaccuauucaagaguuaguacacaacagcaacaacuucgagauugaccacauccuaccauuaucacucucauucgacgacucacuagcaaacaaagucuuaguauauagcuggacaaaccaagagaaaggacaaagaacaccuuaucagguaauagacaguauggacgccgcuugguccuucagagaaaugaaagauuauguacucaaacaaaaaggauuaggcaaaaagaaacgagauuauuuauuaacaacugaaaauauagauaaaauagaggugaaaaagaaauuuauugaacgaaaucuuguagauacaagauacgccaguagaguuguacuaaauagcuuacaauccgcucucagagagcuggggaaagauacaaaagugagcguaguaagaggucaauuuacaucucaauugaggaggaaauggaaaauagacaaaucaagagaaacauaucaccaucaugcuguugacgcauuaaucauagccgcaucuagucagcuuaaacuaugggaaaaacaagacaaucccauguucguagacuauggaaauaaccaaguagucgauaaacaaacuggagaaauccuuagcgugucagaugaugaauauaaagagcuaguauuucaaccuccauaucaaggcuuuguaaacacaaucucgucaaaaggauucgaagacgaaauacuguucagcuaccaaguagauagcaaauacaaucgaaaaguaucagacgcaacuauauacaguacacgaaaagcuaaaauaggaaaagacaagaaagaagaaacauacgucuuaggcaaaauaaaagacaucuauagucaaaacggauucgacacuuuuguaaagaaauacaauaaagauaaaacacaguucuuaauguaccaaaaagacccacucacgugggaaaacguuauugaaguaauuuuaagagacuauccaacgacaaagaaaucugaagauggcaaaaaugacguaaaaugcaauccauucgaagaauacagacgagaaaacggauugauaugcaaauauucuaagaaaggaaaaggcacaccaauuaaaucauuaaaauauuaugauaagaaauuaggaaauuguauagacauuacaccucaagaaagcaaaaaccgugugguauuaagacaaauaagcccauggagagcggacauauacuuuaacccagaaacccuaaaauaugaacucaugggucuaaaauacucagaccuaucauucgaaaaaggcacugguaaauaccauauaucgcaagagaaauaugacgcgauaaaagaaaaagaaggcguaggaaaagacagugaauuuaaauuuacauuauaccguaacgacuuaauacucauaaaagacacacugaacaacugugaacgaaugcugcguuuuggaagcaaaaacgacacaaguaaacauuacguggagcugaaaccauuagaaaaaggaaccuucgauagugaggaagaaauuuuaccaguacuaggaaaaguggccaaaucagggcaauucauaaaaggacuaaacaaaccaaauauuucuauauauaaaguuagaacagauguauuaggaaauaaauacuuugucaagaaagaaggcgauaaaccaaaauuagauuuuaaaaauaacaagaaauga

SEQ ID NO: 5137 - RNA, 3390 nt, Artificial Sequence
  Cas9 variant
augucgaacggaaaaauauuaggacucgacaucgguguagccaguguaggcguugguauaauagauucaaaaacaggaaauguaauacacgcaaacaguaggcuauuuuccgccgcaaacgcugaaaacaaugccgaaagaagaggauuccgcggagcucgaagacuaacuagaagaaagaaacauagagucaaacgcguaagagaccuauuugaaaaauaugauauaagcacugauuuuagaaaccucaaucuaaacccauacgaauuaagaguuaaaggauugacagaacaauuaacgaaugaagaacuauucgcagcgcuaagaacuauagccaaacggcgagguauauccuaucuagaugaugcagaagaugauucgacaggaagcagcgacuaugcaaaauccauagaugaaaacaggcgcuuauuaaaaacuaaaaccccgggacaaauccaauuagaacgacuagaaaaauauggucaacuaaggggcaacuuuacaguguacgacgaaaacggugaagcacaccgauuaauaaaugucuucucuacaucugacuacaaaaacgaagcuagaaagauccuggaaacucaauccaauuauaauaaacaaauaacagaugaauucauagaagauuacauagaaauauuaacacaaaagaggaaauauuaucauggcccaggaaacgagaaaaguagaacagauuacggacgcuuuagaacagauggaacaacgcuugaaaacauuuucggcauauuaauaggaaagugcucuuucuauccggaggaauaucgagcaucaaaagcaucauacacagcccaagaauucaauuucuuaaacgaccuaaauaacuuaaaaguaccaacggaaaccgggaaacuaucaacagaacagaaagaguacuuagucgauuucgccaaaaaaaguaaagcucucggugcuucaaaacuauuaaaagaaauagcaaagauaguggacuguucgguagacgacauaaaaggauaccggguugacaauaaagacaaacccgacuugcauacguuugaaccauacagaaaauuaaaauucaauuuaagcucaaucgacauagacgaauuaucaagagaaacacuugauaaacuagcggauauauuaacuuuaaacacagaaagagaaggcauugaagacgccaucaaaagaaacuuaccaucucaauuuacagaggaacaaauauccgaaauaguacaaauaaggaaaaaccaauccucagcuuucaacaaaggauggcacaguuuuucagcaaagcucaugaaugaauuaauaccagagcuauauguaacuucggaagaacaaaugaccauccuaacucgacuggaaaaauuuaaggucaauaaaaaaagcucuaaaaacacaaaaacaauagacgaaaaagaaauaacagaugaaauauacaacccagugguagcaaaaucagucagacaaacaauaaaaauaauaaaugcagccguuaaaaaauacggugauuucgacaaaauagugauagagaugccaagggauaaaaacgccgaagacgaaaaaaaauuuauugacaaaaaacaaaaagaaaauaaaaaagaaaaagacgauucauuaaaaagagcagcguuuuuauacaacgguaccgacaauuuaccagacgguguauuccacggcaacaaagaacuuaaaaccaaaauacgauuaugguaccaacagggcgaaaggugucuuuacagugggaaguuaauaaguauccaugaucuaguucauaauagcaacaaauucgaaaucgaccacauauuaccacuaagucuaaguuucgacgacagucuagccaauaaagucuuagucuaugccuggacaaaucaagaaaaaggacaaaaaacacccuaccaagucauagacucaauggacacugcauggucauuucgagaaaugaaagacuacguguugaaacaaaaaggauuaggcaaaaaaaagugugaauaccuauuaacaacugagaauauagacaaaauagaaguuaaaaaaaaauucauagagagaaaccuaguugauacuagauacgcaagucgagugguacuaaauucacugcaaaccgcacuaaaagaacuaggaaaagacacaaaaguaagcgucguaagaggucaauucacgagucagcuacgaagaaaauggaacauagacaaaucacgagagacuuaccaccaucacgcagucgacgcauuaaucauagccgcaaguucccaauuaaaacuauggcaaaaacaagaaaacccuauguuugaaucauauggagaaaaucaggucguaaauaaagaaacgggagaaauacugucaaucagugacgacaaguauaaagaacugguauuccaaccgcccuaccaaggauuuguaaauacuauaagcaguaaagguuuugaagaugaaauauuauucucauaccaaguagauagcaaguucaauagaaaaguaucagacgccacuauauacaguacaagaaaagccaaauugggaaaagauaaaaaagaugaaacauacguucuuggcaaaauaaaagauauauauucacaggaugguuucgauacauucauaaaaagauauaaaaaagauaaaacucaauuccuaauguaucaaaaggacccacuaacaugggaaaauguaauagaaguaauacuaagagauuacccaagugaaaaacugucugaagacgggaaaaaaacuguaaaaugcaacccauuugaagaauauagaagggaaaacggacuaaucugcaaauauucaaaaaaaggaaauggaacaccaauaaaaucauuaaaauauuaugauaaaaaacuaggaaauuguauagacauaacaccggaaaagaguaaaaaccgaguaguauuaagacaaauaagcccauggagagcagacaucuauuucaaccuugaaacuuuaaaauacgaacuaaugggccuaaaauacucugauuuaucauucgaaaaaggaacaggaaaauaccacauaucgcaagaaaaauacgaugcaauucgagaaaaagaagggauaggcaaaaaaucagaauuuaaauuuacacuauauagaaacgacuugauccuuauaaaggacacauuaaacaauugcgaaaggaugcuaagauucggaucaaaaaacgacacaucaaaacacuacguagaauuaaaaccguuagaaaaagggacauucgauuccgaagaggagauucuacccguucucgguaaagucgcuaaaucaggccaauucauuaagggauuaaauaaaccaaauauuucaaucuacaaaguaagaaccgauguacuaggaaacaaauucuucauuaaaaaagaaggcgacaaaccgaagcuggauuuuaaaaauaacaauaaauga

SEQ ID NO: 5138 - RNA, 3390 nt, Artificial Sequence
  Cas9 variant
augaguaacggaaaaauacuaggcuuggacauaggaguagcaucaguagggguaggcauaauagaugcgaaaacgggcaacguaauccaugcuaacagucgauuauucucagcagccaacgccgaaaacaaugcugaaagaagaggguucaggggagcaagacgacuaacaagaagaaaaaaacauagagucaaacgaguaagagacuuauucgaaaaauaugacauuagcacggacuuuagaaacuuaaaucucaacccauacgaacucagaguuaaaggauuaacagagcaauuaacaaacgaagagcuuuucgccgcccuaagaacaauagcaaaaagaagaggaauauccuaccuagacgacgcagaagaugacucgacuggaaguucagauuaugcuaaaaguauagacgaaaauagaagacuguuaaaaacuaaaacuccuggucaaauccaacucgaacgacuugaaaaauauggacaacuccgagggaacuucacuguauaugaugaaaacggcgaagcucaccgauuaauaaacguauucuccacaucagauuacaaaaacgaagcaagaaagaucuuagaaacccaaaguaauuacaacaaacaaauaaccgacgaauucauagaagauuacaucgaaauacuaacccaaaaacggaaauauuaccauggaccagguaacgaaaaaagucguacagacuacggaagguucaggaccgaugguaccacacuagaaaacauauuuggcauacuaauaggaaaaugcucauucuacccagaggaauaucgcgccagcaaagccagcuacaccgcacaagaauucaauuuucugaacgaccuaaacaacuugaaaguaccgaccgaaaccggaaaacuaagcacagaacaaaaagaguaccuugucgacuucgcaaaaaaaucaaaagcacuuggcgccagcaaacuccuaaaagaaauugccaaaauagucgauugcucuguagaugacauaaaaggcuauagaguagauaacaaagauaaaccagaucuacauaccuucgaaccauaucgcaagcuaaaauuuaaccucucaaguaucgauauagaugaauuaucacgagaaacucucgauaaauuagcagacauuuuaacacuaaacacagaaagagaaggcauagaagauacaauaaagcgaaaccuaccuagucaguucacagaagaacaaaucuccgaaauaguacaaauacgaaaaaaucaaagcucagcuuucaacaaaggcuggcacucauucucagcaaagcuaaugaacgaacucauacccgaacuauacguaacaagcgaagagcaaaugaccauacuaacuagauuagagaaauuuaaagucaauaagaaaagcaguaaaaacaccaaaacuauagaugagaaagaaauaaccgaugaaauuuauaacccgguagucgcgaaaagcguuaggcagacgauuaaaaucauaaacgccgcaguaaaaaaauauggugacuucgauaagauuguaaucgaaaugccaagagauaaaaaugcagaagacgaaaaaaaguucauagacaaaaaagagaaagaaaauaaaaaagaaaaagaugacucacuuaaacgcgcagcauuccuuuauaacggcaccgauaaccuaccggacggcguauuucacggaaacaaggaauuaaaaacaaagauacggcugugguaccaacaaggagaaagaugccuguacucagggaaacucauuaguauacacgaccuaguacauaacuccaacaaauucgaaauagaucauauacuaccgcuaucccuaaguuucgacgauucacuagcaaacaaaguacuuguauacgcauggacaaaccaagaaaagggacagaaaacuccuuaucaaguaaucgacagcauggaugcggcauggucauuccgagagaugaaagacuacguacuaaaacaaaaaggcauuggaaaaaaaaaaagggaauauuuauuaacaacugaaaacauagacaaaauagaagugaaaaaaaaauuuauagaaagaaacuuaguagacacucgcuaugcuucgcguguaguucuaaacucauuacagacagcucucaaagaacuuggaaaagacacgaaagugucaguugucaggggacaauuuacaucacaacuacgacgaaaauggaaaauugauaaaagcagagaaacauaucaccaccaugcaguagacgcacugauaauagcagcaucaggacaacuuaaacucuggcaaaaacaugaaaaucucauguucgaaaauuacggugaaaaucagguaguaaacaaagaaacuggugagauauuaagcauaucagacgacgaauacaaagaacuggucuuccagccucccuaucaaggcuucgucaauacaauaucaagcaagacuuuugaagacgaaauacuauucaguuaccaaguagacaguaaauucaauagaaaaguaagugaugcaacuauauauagcacgagaaaagcuaaguuaggaaaagauaaaaaagaagaaacuuacguauuaggaaaaauaaaagacauauauacacaagacggauucgacaccuucauaaaacgauacaaaaaggacaaaacacaauuucuaauguaucaaaaggacccccuaacaugggagaauguaauagaagugauccuacgcgacuauccauccgaaaaguuaucagaagacggaaagaaaacagucaaauguaaucccuucgaagaauauagaagagaaaacggucuaaucugcaaauacucaaaaaaaggaaauggcacaccaauaaaaagccuaaaauauuacgacaaaaaacuugguaauuguauagauauaacaccagaaaaauccaaaaacagaguuguacucagacaaauaaguccauggagggcagacauauacuucaaucuagaaacauuaaaauacgaacuuaugggacuaaaguacagcgaccucucauucgaaaaaggaacaggaaaauaccacauuucacaagaaaaauacgaugcaauaagagaaaaagaagggauagguaaaaaaucagaauucaaauuuacauuauacagaaacgacuuaauuuugauaaaagacacucuuaacaauugugaacgcaugcuacgauuugguagcaaaaaugacaccaguaaacauuauguagaacuaaaaccucuagaaaaaggaacauucgauucagaagaagagauucuuccaguucuaggaaaaguagcaaaaucuggacaauuuauuaaaggucuaaauaaaccgaacauaagcaucuacaaaguacgaacagacguauuggguaacaaauuuuucaucaaaaaagaaggagacaaaccaaaauuagacuuuaaaaacaacaauaaauga

SEQ ID NO: 5139 - RNA, 3393 nt, Artificial Sequence
  Cas9 variant
augaauaaaauucuaggacuagacuuggggacaaacucaauaggaugggcccuuauagaaaacaauauaauacucggcaugggaucacgagucuucccagaaggaguuguuaaccugggcgaaggugaaggaagagaaaccucgaaaaacgcaucuagaaccgaagcacgagggguucgacgacaaauauucagaagaagacuuaggaaaagauaccuauuaaaagaacuugcuaaacauaaccuauguccaauaucaccaacauuaauuaaagacuggaauggaacagacauauuuaaaaacgaauuaauuauacaaugguuccaauuaaacccuuacgaacugcgagcuaaagcgauucaagaagaaauaacauuaauagaacuuggcaggauuuucuaucacaugauacaaagacgaggauuucuuucaaauuccagauccgcgggugcagacguaaaagaaacgucaacuauauucaaaggcgacgcuaaaauaggaaaaauagguauaucagacacauuaaaaucgauagaacaaaacaaaacacuaggaucauuucuucacucaauacaacccaaagaaaacgaaccauuuaguggagaauuagaacgcaucagaaaccgcuacaccacccgacaaauguauauagacgaguucgaaacaauuugggaguuccaaaaacaauaccauucggaacugaacucuaaccucaaaaccauucuaggaggcagaaagaaagacaauuacaaagaagauggaguucucuuucaucaaagaccacuaagaucacaaaaacaccuaguagguuuuugcaguuucgaacccaagaaaacaaaaugcaaauuauccgcaauaccauuugaacuauucaggauauaccaauggguaaacacucucucguacgacguuaauggaguaagacagaaaauuacacaagaagaacguaagaaaauaauagacuuauuacuuucgaaagaaaaaccaaguuuuaaagaaauaagaaaagcaauagguaaauuggacggaagcuaccaauuuaacuacaaagaugacgacaaaauagugggaucucauacaaucaguaaucuauccaauaagaaauucuucggaaauaaaugguuugacuuuucagaaaaagaacaagaaaacauauggcacaucuuaaguuucuuugaugacagagaaaaacuaaaagaauacgcgauuaaaaacugguccuuugacgaagaaagagcaguuaaaaucaguaaauuuaaccugaaagacggguauucuaauuuauccagaaaagcaauccuaaacauccucccuuuucuacaaaaaggauuuauguacgauguugcaguaggacuugcaggagucaaaaauacuuuaucagucaacugggaagaacaugaacaauuugugcuugacaaugucccugagauaguaagauccaauuuaaaaggcggauacauugaaccauuaaagaacaugcuuaaaaaugaguucaauuguaacgacaaacaauuagaaaaacuauaccaucauagcucagcaauagaaacggaaaauauacuugacagacuuccaguaaaccuacacgcagaucgugaaauucagaaaaucaaaaacccuguaguaauaacugcacucuucgaaauaagaaaauuagucaaugaaguaauagacacauauggaaaacccaacgaaaucaaagucgaauuagcuagagaucuaaaagcaucuaaaaguaauagacuagaagcacguaaaagacaaaaagaucuagaaaaacaaaacgaucgaguaaaauuagaauuagagaauuuaaaccaacgaucaaaccauauaaacauccuaaaauacaaauuaugggaagaaugcaaccacacuuguccguuuacaggacaaauaauaacuauuucccaacucuuuacuggagaaguacaaauagaacacaucuuuccuuggucaagaucuuuaaacgacaguuucaacaauaaaacucuuugcuucgcagacgaaaauagagccaaaggaaacaaaacaccauacgaauuauauagcgaacaaggagaccaaaaaugggaggccaucaaacuccaagcauuaucaugcuucaaaaccaaagcuaauuacccaaacugcuauaauaaauuuaaacauuucgugaaaaagaaacacgaugaagauuucauauccagacaacugaaugauacucgauauauuucaaaagaagcuaaaaauuaucuuaguaaaauauguuccaaugugcuaguagcaccaggccaaaugacggcaacucuacgacaucauuggggauuaaauagcauacuuaacuuagaagacgacacuaaaacacgugacgaccacagacaucaugcaaucgacgcccuaguaauggcaugcucaacccgaucacaucuacaagaacuaucaaaaagaaaccgauauaauaaaaacuaugauuuaaaagauuuuccggaccccuggcaaaacuuuagacaggacgcggaaaacgcaguugcacaaauacuugucagucauaagaaaagcaaaucacuccuaacaguuagaacccacaaaacuauaaagaaaggcguagaacauaaaaacauaggaguugcugcacgggggcaacuacacaaagaaucaguuuauggacugcgaaaagcacccaacagcaauaaagccuuccauauucgaaaaccauuagagucuuugaccacagaaaaacaacuugagaaaauuguggacgauucaauaagacuacuuauauuaaaaagaauaaauauaauuggaggguuuauuaaagggaaaauaccaaaagaaacauucuucguaguagaugaaaauggaauaaaacaaccucaaauauuucucccaaacagaaauggaaacccaguaccgauuaagaaaguaagaauaagggaaaacauugguggagcagaaaaacuaaaagagaauacaaaccaauacguaaauccacgaucaaaccaccacgucaucguuuaugaagauucgaauggaggccuaaaagacgauguaguaacuuucuggacugcaguagaaagaaaaagacaaggacaagaugucuucaaacuaccgaacgacggagagaaaaucgugucaacucuacagauuaaugauauguuccuacuaggacuaaacgacgacgacaucauaacauuaacaaguaaagaacuaaagaaacaucuauuuaaaguccaaacacuaaguucaucauucuacgaguuccguuuaaguacagauucaacacaaaacaaaaauacaaacagcacaguguucagaaggauacagagcuucggaauggguaaaacaggauggaaagcauucaauccaauaaaaguuaaauuaaacucaauuggcgaaguuaaaauaauauga

SEQ ID NO: 5140 - RNA, 3393 nt, Artificial Sequence
  Cas9 variant
augacgaauggcaaaauauuaggacuagacauaggcauagccaguguugguguaggaauaauagaagcaaaaacuggaaaaguaguacaugcaaacagucgauuauuuagcgcagccaacgcagaaaacaaugccgaaagacgaggauuucgcgguucacggcggcuuaaccgacgaaagaaacacagaguuaaaagagugagagauuuauucgaaaaauacggaauaguaaccgauuuucgaaaccugaaucucaauccauacgaauuaagaguaaaaggauuaacagaacaacuaacgaaugaagaacuauuugcagcuuuacgcacaauaucaaaaagaagaggcauaucauaucucgacgaugcggaagaugacucaacaggaaguacugacuacgcuaaaagcauagacgagaacagacgauuacuuaaaaccaaaacuccagggcaaauucaacuagaaagacuagaaaaauacggacaacugagaggaaacuuuacuguauacgaugaaaauggcgaagcucacagacuaauaaauguauuuaguacaucagauuaugaaaaagaagcccgaaaaauucuagaaacccaagccgacuacaauaagaaaaucacagcagaguucaucgacgacuacguagaaauacuaacacaaaaacgcaaauacuaucaugguccuggaaaugaaaaaucacguaccgauuacgguagauucagaacagauggaacaacgcuugagaacaucuucgggauauuaaucggaaaaugcucauuuuauccagaugaauacagagcuucgaaagcauccuauacagcacaggaauauaacuuuuuaaacgacuuaaacaaccuaaaaguaccaaccgaaaccgguaaacucucaaccgagcaaaaagaagcccuagucgaguucgcaaaaaguacagcuacauuaggaccugcuaaacuauugaaagaaauagcuaaaaucuuagauugcaaaguggaugagauaaaaggcuaucgagaagaugacaaaggcaaaccagauuuacauacauucgaacccuacagaaaacucaaauuuaaucuagauucaguaaauauagaugauuuaaguagagaagugcucgacaaacuagccgacauacuaacccugaacaccgaaagagaaggcauagaagacgcgauaaaaagaaauuuaccaaaccaguuuacagaagaacaaauaagugaaaucauaaaugucagaaaaagccaauccacagcguuuaauaaaggcuggcacucauucucagccaaauuaaugaaugaauuaauaccagaacuauacgccacaucagacgaacagaugacgauucugacaagguuagaaaaauucaaaguuaaaaagaaaucaucuaaaaauauaaaaaccauagaugaaaaagagauaacagacgagaucuauaauccaguagucgccaaaucaguaagacaaacaaucaaaauaauuaacgccgcagugaagaaauacggugacuuugacaaaaucguaauagaaaugccgagggacaaaaacgccgacgacgaaaagaaauuuauagauaaaaggaauaaagaaaacaagaaagaaaaagaugaugcccugaaacgugcagcuuaccuuuauaacgggacagauaaauuaccggacgaagucuuucacggaaacaaacagcuugagacaaaaaucaggcuuugguaucaacaaggagagcgcugucuauacucaggaaaaccaauaccaauacaggagcuaguacauaauucaaauaauuucgaaauagaucauauacuaccauuaagccuaaguuuugacgacucucuugcaaacaaaguucuaguauauucauggacaaaccaagaaaaaggacaaaggacuccauaucaaguuauagacagcauggacgcagcuuggucauucagagaaaugaaagacuauguccuaaaacaaaaaggguuagguaaaaagaaaagagacuaccuuuuaaccaccgaaaacauagauaaaauagaaguuaaaaagaaauucauugaacgaaauuuaguagauacacgauaugcauccagagucguacuaaacucacuacaaagcgcccuaagagaacuaggaaaagacacaaaaguaagcguaguaagaggccaauuuacaucacaacuacgcagaaaauggaaaauagauaaaucaagagaaacauaucaccaucacgcagucgaugcguuaauaaucgcagcgagcucgcaacugaaacuaugggaaaaacaagauaauccaauguuuguagauuacggaaauaaucaaguaguagacaaacaaaccggcgaaauacuauccguuucagacaacgaauacaaagaauuaguauuucaacccccauaucaaggauucgucaauacaauuuccucaaaaggauuugaagaugaaauacuauuuucauaccaaguugacaguaaauacaauagaaaaguuagugacgcaaccauauauucaacaagaaaagcaaaaauaggaaaagacaaaaaggaagaaaccuacgucuuagguaagauaaaagauauauacucacaaaacgguuucgacacguuuguaaagaaauauaauaaagauaaaacucaauuccugauguaccaaaaagauccauuaacaugggaaaauguuauagaaguaauauugggagauuacccuacgacaaagaaaagcgaagacgggaaaaacgauguaaaaugcaacccauucgaagaauaucgaagagaaaacggacuaauaugcaaauacagcaagaaaggaaaaggaaccccaauaaaaucuuuaaaauacuaugauaagaaacuaggaaacuguauugacauaaccccagaagagucacgaaacaaaguaauacuacaaagcauuaauccauggagagcagacguauacuucaacccugaaacacuaaaauacgaacucaugggucuaaaauauucagaucuaaguuuugagaaaggaacaggaaacuaccauauuucacaagaaaaauaugaugcaauuaaagaaaaagaaggaauuggaaagaaaucagaguucaaauucacuuuauaucgcaaugauuuaauauuaaucaaagacauagcaucaggcgaacaagaaauauauagauuccuaagucgcacaaugccuaacguaaaccacuacguagaacucaaaccauaugacaaagaaaaauucgacaacguccaggagcuagucgaagcacuaggcgaagcagacaaaguggggcgcuguauaaaaggauugaauaaaccaaacauaagcauauauaaaguaaggacagacguacucggaaauaaauacuucguaaagaaagaaggcgauaaaccgaaacuagacuuuaaaaacaacaagaaauga

SEQ ID NO: 5141 - RNA, 3393 nt, Artificial Sequence
  Cas9 variant
augaccaacggcaaaauauuaggccuagacauuggaauagcaucaguaggaguaggaauaauagaggcaaaaacaggaaaagugguucacgcaaacucaagacucuucagcgcagccaacgccgaaaacaacgcagagagacgcggcuuccgagggagucgaagacuaaacaggcgaaaaaaacaccgaguaaaacguguaagagaccuauucgaaaaguaugaaauagugacagauuucaggaacuuaaaccuaaaucccuaugagcuccggguaaaaggacugacggaacaauuaacaaacgaagaauuauuugccgcucuacgaacgauaucuaaacgaagaggaauaucauaucuggaugacgccgaagaugacucgacagggagcacagauuacgcuaaaagcauagacgaaaacagaagauugcucaaaacaaagacccccggacaaauacaauuagagagauuagaaaaauacggacaacuacgaggcaacuucaccguauacgacgaaaacggcgaggcacauagacuaauaaauguauucucaacaagcgacuacgaaaaagaagcacguaaaauccuggaaacacaggcugacuacaauaaaaaaauaacagcagaauucauagacgacuacgucgaaauauuaacacaaaagagaaaauauuaccacggaccagguaacgaaaaaagcagaacagacuauggaagauuccggacagauggaacaacacuagaaaauauuuucgguauccuaauaggaaaauguagcuuuuauccagaugaauacagggccucaaaagcaagcuacacggcucaagaauauaacuuucuaaacgacuuaaauaaccuuaaaguaccaacagaaacuggaaaauuaucuacagaacaaaaagaagcccuuguagaauucgcaaaaagcacggcaacgcuuggaccagcaaaauuacuaaaagaaauagcaaaaauacuagauuguaagguagaugaaauaaaaggauacagagaggacgauaaaggaaaaccagaccuacacacauucgaaccauaccgaaagcuaaaauucaaccuagacaguguaaauauagacgaccuaucccgugaaguacuugauaaacuagcagauauucucacacugaauaccgaacgagaaggaaucgaagacgcaauuagacauaaccuccccaaucaauuuaccgaaggacaaauaucagaaaucauuaaaguacgaaaaucccaaagcaccgcauuuaacaaaggauggcacaguuucagcgcaaaauuaaugaacgagcucauccccgaacucuacgccacaagugaugaacaaaugacuauacucacaaggcucgaaaaauuuaaaguaaacaaaaaguccucuaaaaauacaaagacaaucgaugaaaaagaaguuacggaugaaauauacaacccaguaguagcuaaaaguguuagacaaacaauaaaaauaauaaaugcagcagugaaaaaauacggagacuuugauaaaauaguaauagaaaugcccagggacaaaaacgcugacgaugagaaaaaauucauagacaaaaggaacaaagaaaacaaaaaagaaaaagacgaugcacuaaaacgagcagcauaccuuuauaauggcacggacaaacugccagacgaaguauuccacggaaacaaacaacuugaaacaaaaauaagacuuugguaucagcaaggggaaaggugucuauacucuggaaaaccaaucccaauacaggaguuaguccacaauucaaacaacuuugaaaucgaccauauauuaccacuuucauuaaguuucgacgacucccucgcaaauaaagugcucguuuaugcuuggacaaaucaagaaaaaggucaaaagaccccauaucaagugauagauagcauggacgcagcauggucauuuagagagaugaaggacuauguacuaaaacagaaggggcuaggaaaaaaaaaacgggauuauuuacuaacgaccgaaaacauagacaaaauugaaguaaaaaaaaaauucauagaacgaaauuuagucgauacuagguaugcaaguagaguggugcucaacuccuugcaaucagcauuaagagaacuugggaaagacacuaaaauaaguguaauccgaggacaauuuacaagccaacuaagaagaaaauggaaaauagacaaaucaagagaaacauaccaucaccacgcaguagaugcacuaauuauagcagcaucuucacaacuaaaacuaugggaaaagcaggacaauccaauguucguagauuauggaaauaaccaaguaguagauaaacaaaccggugagauauuaaguguuucggacgaugaauacaaagaauuagucuuccagcccccguaccaaggcuucguaaacaugaucucuaguaaaggauucgaagaugaaauuuuauucucuuaccaaguggauaguaaauacaaucgaaaaguaagcgacgcaacaauauauucaacuagaaaagcuaaaauuggaaaagauaaaaaagaagaaacuuacguauuaggaaaaauuaaagacauauacucucagaacggcuucgacaccuuuauaaaaaaauacaacaaagacaagacacaguuccuaauguaccaaaaagaucccuuaacaugggaaaacguaauagaaguaauauuaagagacuaccccacaacaaaaaaaagugaagauggcaaaaacgacguaaaauguaacccuuucgaggaauauagaagagaaaaugggcuagucugcaaauauagcaaaaaaggcaaagguaccccgauaaaaagccuaaaauauuacgacaaaaaacuagguaacuguaucgauauuacucccgaaggaucaaaaaacgaagucguacuacaaagcuuaaacccguggagggcagacgucuauuucaauccggaaacacucaaauaugaauuacucggacuaaaauauucagaucuaagcuuugaaaaaggcacaggaaaauaucacauaagccaagaaaaauacgauguaauaaaagaaaaggagggaauaggaaaaaagagugaauuuaaauucacacuauauagaaaugaucugauucuaauaaaagacaccgcaucaggagaacaagaaauuuauagauuuuuaucacgaaccaugccuaacgugaaacacuaugcagaauugaaaccauaugacaaagaaaaauuugauaauguacaagaauuaguagaagcauuaggagaggccgacaaaguaggcagaugcauaaaaggguuaaauaaaucaaaucuuagcauauauaaaguuaggacagauguauugggaaacaaauauuuuguuaaaaaagaaggagacaaaccuaaauuagauuucaaaaacaauaaaaaauga

SEQ ID NO: 5142 - RNA, 3393 nt, Artificial Sequence
  Cas9 variant
augaccaaugguaaaauacuugguuuagauauuggaauugcuaguguuggagucggaauaauagaagcaaaaacagguaaaguaguccacgcaaacucacgccuauucucagccgcaaacgccgaaaacaaugcagaacgacgaggauucagaggaaguaggcgacucaaccgaagaaaaaaacacagaguuaaacguguucgcgaccuauuugagaaauacggcauuguaacagacuuccgaaacuuaaaccuaaauccuuaugagcucagagucaaaggacugacagaacaauuaaccaaugaggaacuauucgccgcacuccgaacaauaucgaaacgcaggggcauaaguuacuuagaugacgcagaggaugacagcacagguaguacagauuaugcuaagaguauugaugaaaauagaagauuauuaaaaaccaaaaccccaggacagauacagcuugaaagauuagagaaguacggacagcuaagaggcaacuucaccguauacgaugagaauggagaagcucacagacuaauaaacguauucagcacauccgauuacgaaaaagaagcaagaaaaauccuagaaacacaagcggauuauaacaaaaaaauaacagcagaauucauagacgacuauguagaaauucucacucaaaaaagaaaauacuaccaugggccgggaaacgaaaagucaaggacggauuauggaagauucagaacagacggaaccacuuuggaaaauauuuucggaauccucauuggaaagugcaacuucuauccggaugaauauagggcaucuaaagccucauacacggcgcaagaauacaacuuccuaaacgaccuaaacaaccugaaaguuccaacagaaacagguaaacuauccacagaacaaaaagaaucacucguugaguuugcaaaaaacacagcaauucuagguccagcaaaacuacucaaggaaauagcaaaaauacucgacugcaaaguagacgaaaucaaaggauauagagaggaugauaaaggaaaaccggauuuacacacauucgaacccuaccgaaaacucaaauuuaaccuagauucagucaauauugacuacuugucuagagaaguacuagauaaauuagcagauaucuuaacauugaacaccgaacgagagggaauagaagaugcaauaaagcgaaacuuacccaaccaauucacugaggaacaaauaucagagauuaucaacguccgaaaaagccagucuacagccuuuaauaaaggauggcauaguuucagugcuaaacugaugaaugaauuaauaccagaacucuacgcuaccagugacgaacaaaugacaauacucacgagacuagaaaaauucaaaguaaaaaaaaaaagcuccaaaaauauaaaaacaauagacgaaaaagagaucacagacgaaauauacaauccagucguagcaaaauccguacgucaaacaauaaaaauaauaaaugcagccguaaaaaaauacggagauuuugacaaaauuguuauagaaaugccccgagauaaaaacgcagacgaugagaaaaaauucauaaacaaaagaaacaaagaaaacaaaaaggaaaaagacgacgcccuuaagagagcugcuuaccuauacaacgguacugauaaacuaccagacgaaguuuuccauggaaauaaacaacuagaaacaaaaauucgauuaugguaucaacaaggcgaacgaugcuuauauucaggaaaaccaauaccaauacaggaacuaguacacaauaguaacaauuuugaaauagaccacauacuaccacuaucacuaucauuugacgacagccuggcaaauaaaguauuaguauacagcuggacaaaccaagaaaaaggacaaaaaacaccuuaucaaguaauagacucaauggaugccgcguggucguuccgcgaaaugaaagaguacguacuaaagcaaaaaggcuuggguaaaaaaaaaagagacuaucuauuaacaacagaaaacauagauaaaauagaaguuaaaaaaaaauucauagagagaaaccuaguagauacaagauaugcaaguagaguagugcuaaauucauuacaaagugcauuaagagaacuaggaaaagacacaaaaguaagcguaguucgaggacaauucaccucccaauuaaggagaaaauggaaaauagauaaaucaagagagacauaccaccaccacgcaguagaugccuuaauaaucgcugcuucaagccaacuaaaacugugggaaaagcaagacaauccaauguucgucgacuacggaaauaaucaaguagucgauaaacaaacaggugaaauccuaucagucagcgauaacgaauauaaagaauuaguguuucaaccgcccuaccaagguuuuguaaacacaaucagcucaaaaggauucgaagacgaaauucuuuucaguuaccagguagauaguaaauacaaucgaaaagucucagacgcaaccaucuauucaacacgaaaagcgaaaauagguaaagacaagaaagaggaaacauacguauuagguaaaauaaaagacauauacagccagaauggauuugacaccuucguaaaaaaauauaacaaagauaaaacacaauucuuaauguaucaaaaagacccucuaacaugggaaaacguaauagaaguaauccuaggggacuacccaaccacaaaaaaaucagaagauggcaaaaaugaugugaaaugcaacccauucgaagaauacagaagagaaaauggccuaaucuguaaauauucgaaaaaaggcaaaggaaccccaauaaaguccuuaaaauacuacgacaaaaaauuaggaaauugcauagacauuacaccagaagaaucacguaacaaaguuauccuccaaaguauuaacccguggcgagcagauguauauuucaauccugagacauugaaauaugaauuaaugggauuaaaauacagugacuuaaguuucgaaaaaggcacuggcaacuaccacauaagucaagaaaaauacgaugcaauaaaagaaaaagaaggaauaggcaaaaaaucagaauucaaauuuacacuuuaccgaaacgauuuaauauuaauaaaagauauagcaagcggagaacaggaaauauacagguuccuauccagaacaaugccuaacgugaaucauuacguagaauugaaaccauacgauaaagaaaaauucgauaauguucaagaacuaguugaagcccuaggugaagcugauaaaguaggaagaugcauuaaaagucuaaacaaaccaaauauaagcaucuacaaaguuagaacagacguauuagggaauaaauacuuuguaaaaaaagaaggagauaaaccaaaauuagauuuuaaaaacaacaaaaaauga

SEQ ID NO: 5143 - RNA, 3393 nt, Artificial Sequence
  Cas9 variant
augagcaacggcaaaauauuaggcuuagacauagguguagcaucagucgguguaggaaucauagacgcaaaaacagggaaaguaauacaugccucaagcagacuauucagcgccgcaaacgcagagaauaacgcagaaagaagaggauuuaggggagcaagacgauuaacaaggagaaagaaacaucgaauuaaaaggguaagagacuuauucgagaaauaugaaauaguaaccgauuuuuccaaucuuaauuuaaaucccuaugaacugcgcgucaaaggcuuaacagaacaauuaacaaaugaagaauuauucgcggcauuacgaacaauagcaaagagacgcgggauauccuauuuagaugaugcggaagacgauaguacagguucaagcgacuacgcaaaaaguauagaagaaaaccgacgucuacucaagaauaugaccccaggacagauacaauuagaaagacuggaaaaauauggacaauuaaggggaaauuucaccguauaugaugaaaauggagaagcgcacagauugauaaacgucuuuucaacaucagauuacaagaacgaagcuagaaaaauacuagaaacgcaaucaaauuauaauaaacaaaucacagaugaauuuauugaagacuacauagaaauccuaacucagaaaaggaaauacuaccacggaccuggaaaugaaaaaucaaggacugacuacggacgauauaggaccgaugguacaacauuagaaaauaucuucgguauucuaauaggaaaaugcacauuuuacccggacgaauacagaaccucaaaagccucauacacagcccaagaauacaauuuccuaaacgacuuaaacaaccuaaaaguaccuacagaaacaggaaaauuaucaacugagcaaaagcauuaccucgucgacuucgcuaaaucaucaaaagcauuaggaguagcgaaguuacuuaaagaaaucgcgaagauagucgaauguuccguagaugauaucaagggauauagagaagacaacaaagggaaaccggaucuacacacguucgaaccauaccgaaaacuuaaauucaauuuaaguuugaucgacaucgacgaacuaagccgagaaacccuagauaagcuagccgauauucucacauuaaacacggagagagaaggaauagaagacgcaauaaaaagaaaucuaccaaaucaauucacagaagaacaaauaguggaacugguaaacguaagaaagaaccaaucgucagcguucaacaaagguuggcacucauuuaguguaaaauuaaugaaugaacucauaccagaacucuaugcaaguucggaagaacaaaugacaauuuuaacgagacuagaaaaauucaaaguuaacaaaaaguccagcgaaaacacaaagacaauaaacgagaaagaaauaacagaugaaauauacaaccccguaguagcaaaauccgugucacaaacaguaaaaauaauaaaugcagcaguaaagaaauauggcgacuuugacaaaauaguaauugaaaugccuagggacaaaaacgcggaugacgaaaagaaauucaucgacaagaaacaaaaagaaaacgcuaaagaaguagaagaugcacuaaaaagggcggcauaucucuauaacggaaccgauaaauuacccgacggaguuuuccacgguaacaaacaauuaaaaacaaaaauccgacuaugguaccaacaaggugaaagaugucuguacaguggaaaaccaauaucaauccaagaccucguucauaacucaaacaacuucgaaauagaccauauacucccauuaagucugagcuuugaugauucacuagcuaauaagguguuaguguacgcauggaccaaucaagaaaaaggacagaaaacgcccuaccaagucauagacagcauggaugcagcauggaguuuccgagaaaugaaagacuacguuuuaaaccaaaaaggaauaggaaagaagaaaagagaauacuuauuaacaacggagaacauagauaaaauagaaguuaaaaagaaauuuauagaaagaaaccugguagacacacgauaugcaagcagaguaguucuaaauucuauacaagcagcacuaaaagaacucgauaaagauacgaaaguaucggugauacgaggacaauuuacaucgcaacucagacgaaaauggaaaauugauaaaagcagagaaacauaccaucaucacgcaguagacgcauuaauuauugcagcgucuucccaacuaaaacuauggcaaaaacaagaaaauccaauguucguagauuacggagagaaucaagucgucaauaaagaaaccggugaaauauuaucaguaucagaugacgauuauaaggagcuaguuuuucaaccacccuaccaaggguuugugaacacuauaucaucuaaggcuuucgaagaugaaaucuuauucaguuaucaaguagacagcaaauauaaccgcaaaguaagugaugcaacuauauauagcacaagaaaagcaaaauuaggcaaagacaagaaagaagaaacauacguacuuggaaaaauaaaagacauauacagucaagacggauuugaugcguuuauaaaaagauauaagaaagauaaaacacaauuucuuauguaucaaaaagacccaguaaccugggaaaacgucauagaaguaauacuacgagacuauccaucagaaaaauugucagaagacggaaagaaaaacguaaaauguaacccauuugaagaauacaggcgagaaaacggauugauaugcaaauauagcaagaaaggaaaagggacaccaauaaaaucauugaaauauuaugacaagaaauuaggaaauuguauagacauaaccccaaaaggcagcaaaaacgagguaguacuacaaagccuuaacccguggcgagcugaucuauacuucaauccagacaccuugaaauaugaacucaugggacuaaaauacagugacuugagcuuugaaaaaggaacuggaaaauaucauauuagucaagaaagauaugacgaaauaaaagucaaagaagguauagggaaaaacagcgaguucaaauucacacuauauagaaaugaucugauccugauaaaagauacggaauccggagaagaagaauuauaccgauuucuauccagaacuaugcccaacguaaaacauuacguagaacuuaaacccuacgacaaagaacgauacgacgguggucaagaauuaaugaaaguauuugggaauguagcgaauggaggucaaugccuuaaaucucuaaacaaaucuaaccuaucaaucuacaaaguaaggacggauguauuaggcaauaaauucuuuauaaagaaagaaggagacaaaccaaaauuagacuuuaaaaacaauaagaaauga

SEQ ID NO: 5144 - RNA, 3393 nt, Artificial Sequence
  Cas9 variant
augacaaauggaaaaauauuaggucuagauauaggaauagcgucggugggaguaggaauaauagaagcgaaaacuggaaaaguaguacaugcaaacagccgguuauucagugcugccaacgcugaaaacaacgccgaacgcagagguuuccguggaucaaggagauuaaacagaaggaagaaacaucgaguaaaaagaguacgcgacuuauucgaaaaauacggaauaguaaccgauuucagaaaccugaaucuaaacccauacgaauugagaguaaaaggacuaacggaacaacucaaaaaugaagaacuuuuugcagcacugagaacaauaagcaaaagacgaggaauaagcuaccuagacgacgcagaagaugacagcacgggaagcaccgacuacgcaaaauccauagaugaaaacagaagacuacucaaaaauaaaacaccaggacaaauccaauuagaacgacuggaaaaauauggacaacuacgaggaaacuucacaguuuacgaugaaaauggugaagcacacagauuaauaaauguguuuucaaccucagacuaugaaaaagaagccaggaaaauacuagaaacacaagcagauuauaacaagaaaauaacggcagaguucauagaugauuauguagaaauccuaacucagaaaagaaaauacuaucacgguccaggaaaugaaaaaucgagaacagacuacggacgauucagaacagacgggacaacccuagaaaacauauuuggaauacuuauugggaaauguaauuucuauccagacgaauauagagccagcaaagcaucauauaccgcacaagaauacaauuuucuaaaugauuuaaauaaucucaaaguaucaacugaaacaggaaaacugaguacggaacaaaaagaaagccuagucgaauuugccaaaaauacagccacacuuggaccugcgaaacuacuaaaagaaauagcaaaaauauuggauugcaaaguggacgaaauuaaaggauauagagaagacgacaaaggcaaacccgacuuacauacuuucgaaccguacagaaaacucaaauucaacuuagaaagcaucaauauagacgaucuaagccgagaaguaauagacaaauuagcagauauucugacacucaauacggaaagggaaggaauagaagaugccauuaaacgaaaucuaccaaaucaauucaccgaagaacaaauaagugaaaucaucaaagugcgaaaaagccaaaguacugccuucaacaaaggcuggcauaguuucucagcaaaacugaugaacgaacucauuccagaauuguaugcgacauccgacgaacaaaugaccauauuaacaagacuagaaaaauuuaaagugaacaagaaaaguuccaaaaauacaaaaacuauagacgaaaaagaaguaacagacgaaauauauaacccaguaguagcaaaaucgguaagacaaacgauaaaaauaauaaaugcugcuguuaagaaauauggagacuucgacaaaauaguaauagaaaugccaagggauaaaaaugcugaugaugagaagaaauucauagacaaaagaaauaaagaaaacaagaaagaaaaagaugaugcguuaaaacgagcagcguauuuauauaacucuucggauaaacucccagacgaaguauuccauggaaacaaacaauuagaaacaaaaauaagauuaugguaccaacaaggugaaaggugcuuauacucaggcaaaccaauaaguauacaagaauugguccacaacucaaacaacuuugaaauagaucacauacuaccacuaagccuaucauuugacgauucccuagcuaauaaaguauuaguuuaugcauggacgaaccaagagaaaggacagaaaacgccauaccaagucaucgacuccauggaugcggccuggagcuuccgagaaaugaaagacuacguacuaaaacaaaaaggacuagguaaaaagaaacgggauuaccuauuaacgacagaaaacauagauaaaauagaggucaaaaagaaauuuauugaaagaaaucugguagacacacgauaugcaucaaggguaguacuaaacagccuacaaucagcuuugagagagcucgguaaagacacaaaaguaagcguaguaagaggacaauucaccagccaacucagaagaaaauggaaaauagacaaaagucgagagacauaucaucaucaugcuguagacgcauugauaauagccgccucaucacaauuaaaacuaugggaaaaacaagacaacccaauguucguggauuacggcaaaaaccaaguagucgacaaacaaacuggugaaauuuuaucaguuagugaugaugaauacaaagaauuaguauuucaacccccauaccaaggauucgucaacaccauaagcucaaaaggauuugaagacgaaauauuauucagcuaccaaguagacagcaaauacaaccgcaaaguaagugacgccacaauauacucuacgagaaaggcaaaaauaggaaaagauaagaaagaagaaaccuauguacuaggaaagauaaaagacaucuacagucaaaacgguuucgacacauucaucaagaaauauaacaaagacaaaacacaauuuuuaauguaccaaaaggacagccugacuugggaaaauguuauugaaguaauauugagagauuacccaacuacaaagaaauccgaagacggcaaaaacgauguuaaauguaauccuuucgaagaauacagaagagaaaauggauuaauauguaaauacagcaagaaaggaaaaggaacacccauuaaauccuuaaaauauuacgacaagaaauuaggaaacuguaucgacaucacaccagaagagagcagaaacaaaguaauucuacaaucaaucaaucccuggagagcagacguauacuucaauccagaaacuuuaaaauacgaacucaugggacuaaaauauucagaucuaucauuugagaaaggaaccggaaacuaccauauaucccaagaaaaauacgaugcuauaaaagaaaaagaaggaauaggcaagaaaagugaguucaaauuuacguuauaccgaaacgauuuaauacuaauaaaagacauagccucaggagaacaagaaaucuaucgauuccuaucaagaacaaugcccaauguaaaccacuacguugaauuaaaaccuuacgacaaagaaaaauuugacaauguacaagagcuuguugaagcacuaggagaagcagauaaagucggaagauguauuaagggacuaaauaaacccaauauaucuaucuauaaaguaagaacugacguauuaggaaacaaauauuuugucaagaagaaaggcgacaaaccgaaacucgauuucaaaaacaacaagaaauga

SEQ ID NO: 5145 - RNA, 3393 nt, Artificial Sequence
  Cas9 variant
augacaaacggcaaaauauuaggacuugacauaggaauugcaucugucggaguuggaauaauagaagcaaaaacaggcaaaguuguucacgccaacucacgacuuuuuucagcagcaaaugcugaaaauaaugcagaaaggaggggauuccgaggaucucgaagauuaaauagaagaaaaaaacaucgaguaaaacgaguacgugaccuauucgagaaauacgguauaguuaccgacuucaggaauuuaaaccugaacccauacgaacugagagugaaagggcuaacagaacaacuaacuaacgaagaacucuucgcggcucuaaggacaauauccaaaagaagaggaauaaguuauuuggacgaugcagaagacgauucaacaggaagcacagauuaugcaaaaucaauugacgaaaacagaagauugcuuaagacaaaaacccccggccaaauacaauuagaaagauuagaaaaauacgggcaacugagaggaaauuucacagucuacgacgaaaauggagaagcacauagacugauaaauguauucaguacuagcgacuaugaaaaagaagcaagaaaaauacuugaaacucaggcagacuacaauaaaaaaauuacagcagaauucauagacgauuacguagaaauacuaacccaaaaaagaaaauacuaucacgguccuggaaaugaaaaaucaagaacugauuacgggcgguucagaacagacggcacgacacuagagaacauauuugggauauuaauagggaaauguucauucuacccugaugaauauagagcuucaaaggcaagcuacacugcacaagaauacaauuuccuaaacgaucuaaauaaucuaaaaguccccacagagacaggaaaauuaucgacagaacaaaaagaagcauuaguagaauucgcaaaauccacagccacauuggguccagcaaaauuauuaaaagaaauagcaaaaauacucgauuguaaagucgaugaaauaaaaggguauagggaagacgacaaaggaaaaccagauuuacacacauucgaaccauaucgcaaacuaaaauucaacuuagauucugucaacauugacuacuuaagccgagaggugcuagauaagcucgcggggauacuaacacugaauacagaaagagagggaauagaagaugcaauaaaaagaaacuuaccaaaccaauucacagaagaacagauaucagaaaucaucaacguaaggaaaagucaaucaacggcauucaauaaagguuggcauucguuuuccgcaaaauugaugaacgagcuaauaccagagcucuacgcaacaucagacgaacaaaugacaaucuuaacaagauuagaaaaauucaaagucaaaaaaaaaucaaguaagaacauuaaaacaaucgacgaaaaagaaauuacagacgaaaucuauaacccggugguagcaaaauccguuagacaaaccauuaaaauaauaaacgccgcaguaaaaaaguacggagacuuugauaaaauuguuauagaaaugccaagagacaaaaaugccgacgaugagaaaaaauucauaaacaaaaggaauaaagaaaauaaaaaagagaaagacgacgcauuaaaacgagccgcuuacuuauauaacggaacggauaaacuaccugacgaagucuuccacggcaauaaacaacuugaaacaaaaauccgacuaugguaucaacaaggggaaagauguuuauauucuggcaaaccuauaccaauacaagaacuaguacacaauucaaauaacuuugaaauagaucacauacuccccuuaucacuaucauuugaugacagccuagcuaacaaaguacuaguauacucauggacuaaucaagaaaagggucaaaaaacaccauaucaagucauagacaguauggacgcagcaugguccuuucgagaaaugaaagaauauguacuaaaacaaaaaggacuagggaaaaaaaaaagagacuaucuauuaaccaccgaaaauauagauaaaaucgaaguaaaaaaaaaauucauagaaagaaaucucguagacacgagauaugcaucaagagucguacuaaacagucugcaaagcgcuuuaagagaacuagguaaagacaccaaagucucagucgucagaggucaauucacaagucaauuaagaagaaaauggaagauagauaaaucaagagaaacauaucaccaucacgcuguagacgcacuaauaauagcagcaaguucacaauuaaaacuaugggaaaaacaagacaauccaauguucguggauuaugggaauaaccaaguaguagacaaacaaacaggggaaauccugaguguauccgauaacgaauauaaagaauuaguauuucaacccccuuaucaaggauuugucaacacaauaucaagcaaagguuuugaagacgagauacuuuucucauaccaaguagacucgaaauacaaucgaaaaguguccgacgccacuauauauucuaccagaaaagcaaagaucggaaaagauaaaaaggaagagacuuacguauuaggaaaaauaaaagauaucuauagucagaacggauuugauacuuuuguaaaaaaauauaauaaagauaaaacgcaauuccuaauguaucagaaagauccauuaacaugggaaaacguuauugaaguaauccuaggugacuacccaacaacaaaaaaaucagaagauggaaaaaacgacguaaaauguaacccauucgaagaauacagaagagaaaacggacuaauauguaaauauucaaagaaagguaaaggcacaccaauaaaaucacuaaaauacuaugacaaaaaauuaggcaacuguauagacauaacuccagaagaaucacgaaauaaaguaauauuacaaaguauaaaucccuggcgagcagaugucuauuucaacccagaaacauuaaaauaugaacuuaugggacuaaaguauucugaucuuuccuucgaaaaagggacagggaacuaccacauaucucaagagaaauacgacgcuauuaaagaaaaagagggcauagguaaaaaaagcgaauuuaaauuuacucucuauagaaaugaucuaauauuaauaaaagauauagcuaguggagaacaagaaauuuaucgauucuuaucccgaacaaugccaaacguaaaccacuaugucgagcuaaaacccuacgacaaagaaaaauucgauaacguacaagaauuaguagaggcacuaggugaagcagauaaaguggggcgauguauaaaagguuuaaauaagccaaacauaaguauauauaaaguacguacagacguacucggaaauaaguacuuuguaaagaaagaaggcgacaaaccaaaauuagacuuuaaaaacaacaagaaauga

SEQ ID NO: 5146 - RNA, 3396 nt, Artificial Sequence
  Cas9 variant
auggcccaacacguuuuuggucuugauauaggcauagcgaguguaggaugggccaucuugggggagcaaagaaucauagauuuaggaguuagauguuuugauaaagcagagaccgcgaaagaaggugauccccuuaaucuaacaagaaggcaggcaagauuauuaaggaggagguuauacaggagagccuggagacucacacaacuuaguagguugcuaaaacgaaaaggauuaauagcagaugccaaauuauuugcaaaagcuccuaguuacggagauagugcaugggaacuaagacgacaaggucuggauagacuauuaacaccgcuagaaugggcaagaguaaucuaucaucaauguaaacacagaggcuuccacuggaccucaaaagcagaagaggcaaaagcagacucugacgcugaaggaggaagaguaaaacagggacuugcacacaccaaagcauugaugcaagcgaaaaacuauagaagugcggcagaaaugguauuagcagaauuuccagaugcccaaagaaacaaacgaggucaauaugauaaagcauuaaguagaguuuuacuaggagaagaauuggcauuauuauuugcuacacagagaagacugggcaacccacacgcuucugacuucuuugaaaaacuuauauuaggagauggagaccguaaaucuggauuguuuuggcaacaaaaaccagcucuaaguggugcagaucuacuuaaaaugcuuggaaaaugcacuuuugaaaaaggagaauaccgugcaccaaaagccucauuuagcguagagcgacaugugugguugacaagacuaaauaaucuaagaauaguaguagacgggagaucgaggccacuaaacgaagcugaaagacaagccgcacuccuacuuccauaucagacagaaacaucaaaauacaaaacacuaaagaaugccuuuaucaaagccggucuauggggagaugguguuagauucggaggacuagcauacccuucacaagcucaaauugacgcugagaaaacgaaagacccggaagaccaauuccuaguuaaauuaccggccuggcaugaauuaagaaaggcauuuaaagcagcugggcacgaagcauuguggcaacaaaucucuacaccagcguuagauggagauccaacacuucuagaucaaaucgccacgguauuaucgguauacaaagacggggccgaaguugugcaacaacuaagacaacucgcauugccugagccagcagcaucaauagcuguacuagagaaaauaucauuugauaaauuuucaucauuaucacucaaagccuuaagaagaauaguaccuuuaaugcaaaguggacucagauaugaugaagcaguagcgcaaauacccgaguacggacaccacagucaaaggauagaaccaggagccgcuaaacauuuauaucugcccccauuuuaugaagcacaaagaaaauacgcgggaaaaggagaucauauaggguccaugcaauuuagggacgaugcagauaucccaagaaauccagucguucuucgagcucuaaaccaagcucguaaaguugugaaugcauuaauacgugaauauggaucaccaauagcgguuaauauagaaauggcacgagauuugucaaggccacuugaugaaagaaauaaaguuaaacgagcacaagaagaauuuagggauagaaaugaucgggcaagaagcgaguuugaaagagacuuuggauauaaaccuaaagcagccgccuucgagaaauggauguuauaccgugaacaacuaggacaaugugcuuacucccaacaaccucuagacauacaacggguacuugaugaucauaauuaugcacaaguagaucaugcguuaccuuacucuagaaguuaugaugauucuaaaaauaacaaaguuuuaguucuuacacaugaaaaccaaaacaaaggaaaucggacugcauucgaauacuuaacaaguuuuccagauggggaagauggagaaagauggagaacauucguggcauggguucaaggaaauaaggcuuaucgaauggccaaaagaaauaggcuccuaagaaagaacuaugggguggacgaaucaaaaggguucauagaucgaaaccuaaaugacacaagauacauaugcaaauucuuuaaaaauuauguagaagaacacuugcagcuggcggcaagggcugauggagauacagcaagaaggugcguuguuguaaauggacaacuaacagcguuuuuacgagcgcgauggggacuaacuaaaguaagaggagauucagaccgacaucaugcacuggaugcagcaguaguugcagcaugcacacauggaaugguaaaagcgcuugcagauuauucccgaagaaaagaaauaucguuucuacaagaaggauuuccagauccugaaacuggagaaauauuaaacccagcagcauucgauagagcaagacaacauuuuccagaaccauggacacauuuugcacacgaacuuaaagcaagacuauuuacagacgacuuagcugcucuacgggaggauaugcaacgauuggguagcuauacaaccgaagaccuagguagauuaagaacauuauuuguuaguagagcuccacagcgaagaucagggggagcaguacacaaggaaaccauuuacgcccaaccagagucacuaaaacagcaagggggcguuauugaaaagauuuuauuaacaucucugaaacuacaagauuuugauaaauuacuaaauccagaaucaaaugaccauuuugucgagccgcauagaaacgagagacuuuacgcagcaauuagacaaaggcuugagcaauuuggaggcagagcagauaaagcauuuggaccggauaacuuauuucauaaaccagacaaaaauaaccagccaacaggaccaguagucagaucuauaaaguuaguaagaggaaaacagacuggaaucccaauaagaggugguuuggcuaagaacgauucaaugcuucguguugacauauucacaaaagcaggaaaauuucaucucguuccaguuuauguacaucauagaguaaccggauuacccaaucgagcaauaguagcguucaaagaugaagacgaauggacgcucauagacgaauccuuugcuuuucuuuucucaguauacccaaacgauuauguaaaaguaacacugaagaaagaacaacaaaguggauauuauucaggcgcagacagaaguacaggugcaaugaauuuaugggcgcacgauagagcggcaucuguaggaaaagauggauuaauacgugguauugguguuaaaacagcauuaaguguagaaaaauucaauguagauguauuagguagaauuuaucuagcacccccagagacgagaucuggucuggccuga

SEQ ID NO: 5147 - RNA, 3399 nt, Artificial Sequence
  Cas9 variant
auggcgcaauacguauucgggcuagauauaggaauagccagugucgguugggcaguauuagaugcgcaaagaauagucgacuuaggaguaagauguuucgauaaagcagaaacagcgaaagaaggcgauccacuaaaucuaacaagaaggcaagcgagguugcuaagacgaagguuauauagacgagcauggagacuaacacaauuagcgcgucuguuuaaaagagaaggauuaauagacgacgccaaacuuuucgcaaaggcaccaaguuggaccgaaaaugcaugggaacucagacuaagaggacuagaccaucuguuaacaccauuagaaugggcaagagugauauaucaucuauguaaacaucgaggauuucauuggacuucaaaagcugaagaagcgaaagcugaaucagacgcagaaggugguagaguuaaacagggauuagcacacacaaaagcacuaaugcaaguuaagaauuauagaucuacugcagaaauggugcuugccgaauuuccaggagcacaacggaacaaaagaggccaauaugacaaagcucuaucacgagucuuauuaggugaagaacuugcuuuacuauuugcgacucaaagaagacuaggaaauccccacgcaucugaacauuuugaacagcuuauacucggacacggagauagaaaaaguggacuauuuuggcaacaaaaaccagcguuaagcggugccgauuuauuaaagaugcuuggaaaaugcacauucgagaaaaccgaauacagagcgccaaaagcuagcuuuagugcugaaagacauguaugguuaacgagacuuaacaauuuacgcauugugguugauggcagagcacguccauuaaaugacgcagaaagacaagcagcacuccuauugccauaucaaacggaaacuuucaaauacaaaacauuaaaagccgcuuucgucaaaguugguuuauggggugaugggguacguuuugggggacuagcauacccaucccaagcacaagccgaagcggaaaaagccaaggaucccgaagaccaauuccuggugaaacuaccggcauggcaugaauuacgaaaagcauuuaaagcagcaggacaugaagcauuauggcaacaaaucuccaugcccgcauuagaagaagacccaacuuugcuagaucagauagcgacuguauugucaguauacaaagacggaacggaagugguacagcaacuacgucaauuagcuuugccggaacccgaugcaaguauagcggucuuagaaaagauuagauuugauaaauuuucaagucuuucccuaaaagcucuaagaagaauagugccacuaaugcaaggcggauuaagauaugaugaagcaguggcacaaauaccagaauauggacaucacagccaaagaauugacccaggagcgacaagacacuuauaucuaccaccuuucuacgaagcacaacgaaaguaugcggguaaaggggaucgaauaggaucgaugcaauuucgagaagaugcagauguaccaaggaauccugucgucuuaagagcauuaaaucaagccaggaaaguaguuaaugcacuaauaagagaauacggaagcccuguagcaguaaauauagaaauggcaagagaucugaguagaccacuagaugaaagaaauaaaguaaaacgagcucaagaagaauuuagggaucggaacgauaaagcgcguucagaguucgaaagagauuucggauauaaaccaaaaggagcuguguuugaaaaauggauguuauacagagaacaacucggacagugugcauacagccagcaaccacuugacauacagagaguguuagaugacccuaacuaugcacaaguagaucaugcacuuccauauaguaggucauaugaugauaguaaaaauaauaagguguuaguguuaacgagagagaaccaaaauaaagguaauagaaccccauucgaauauuuaacaucauucccaggcggugaagacggagagcgauggagagcuuuuguagcauggguacaagguaacaaagcauacagaauggcaaaaagaaacagauuguugcgaaagaacuauggaacagacgaaucaagaggcuucauagauagaaaccuaaacgacacaagguacauauguaaauucuuuaaaaauuacguugaggaacauuuacaauuagcagcaagaacagacggagauacggcacgacgaugcgucgucguuaauggacaacuaacagcauuuuugagagcaagauggggacucgcaaaagugcggggagauagcgaccgucaccacgcauuggaugcugcaguuguugcagcauguacccaugguauggugaaagccuuagcagauuauagcagaagaaaagaaauagccuuucuucaggaagguuucccggauccagaaaccggagaaauuuugaaccucgcagcguucgaucgagcgcgagaacauuuuccagaacccuggccacauuucgcacacgaauuaaaggcuagauuauuuauagaugauuuaguagcacugagagaagauaugcaacaccuggguagcuaugcacaagacgacuuggacagacucagaacacuauucguaucgagagcaccacaaagaagaaauggaggagcaguccauaaaggaacuauauaugcacaaccugagaaucucaaacaacaaggcucaacaauagagaaaauauuauuaacaggauuaaaacuacaagacuucgacaaacuauuaaauccagaaucaagcgaccacuuuguagaaccacacagaaaugaaagauuauaugcagccauaagaagaagauuagaagaguucggugguaaagccgacaaagccuucggaccagauaaaccauucuacaaacccgauaaaaauggacagccaacgggccccauuguaagaucaauaaaacuuguaagagguaaacaaacuggaauaccaauccgaggaggauuggcuaaaaaugauucaaugcuaagagucgauguguuuaccaaagcaggaaaguuucaucuuguaccaguauauguacaucauagaguaacuggacugccagaucgagcaauaguagcauuuaaagacgaagaagaauggaccuuaauagacgaaucauacgcuuuucucuuuaguguguauccaaaugauuuuguaugugugcaacaacgagguaaaccccuaauagaaggauacuacgcaggacuugauagagcaaauggaaauauuaacgucugggcgcacgacagagccgcaaguguagguaaagacggauuaauaagagggauaggaguaaaaaccgcucuaucauuagaaaaacuaaacguggacguuuugggaagaauauauccagcacccccagaaacuagacgagggcuggcuuga

SEQ ID NO: 5148 - RNA, 3399 nt, Artificial Sequence
  Cas9 variant
augaaaaaaaucuuaggcguagacuuaggcauaacaucuuucggguacgcaaucuuacaagaaacagguaaagacuuauaucgcugcuuagacaauucuguaguaaugagaaacaauccuuacgacgaaaaaucaggcgagagcagucagucuauaaggucuacacaaaaaucaaugagaagacuaauugagaaaagaaaaaaaagaauaagaugugucgcucagacgauggaaagauauggaauacuagacuacucagaaacaaugaagauaaaugacccgaaaaacaauccgauaaaaaauagguggcaauuaagggcaguagacgcauggaaacgaccacuaucgccacaagaauuauuugcaaucuucgcacacauggcaaaacacagaggauauaaaaguauugccaccgaagauuuaauauacgaauuagaguuagaacucggauugaacgauccagaaaaggaaucagaaaaaaaagcagacgaaagacgccaaguguacaacgcacuucgccauuuagaagaguuaagaaaaaaauauggcggagaaacaauugcacagacaauacacagggcaguugaagcaggugacuuaagaucguauagaaaccacgacgacuaugaaaaaaugauacgacgagaagauauagaagaagaaauagaaaaagugcuauuaagacaggccgaauuaggcgcguuaggccuucccgaagaacaagucagcgaauuaaucgacgaauuaaaggcauguauaacagaucaagaaaugccaacuauugaugaaucacuauucggaaaauguacuuuuuauaaagacgaauuagccgcgccagcauauucuuaccuuuaugaucuauauagacuauacaaaaaauuagcagaucuuaauauugacggauacgaaguaacacaagaagacagagaaaaaguaauagaaugggucgaaaaaaaaauagcacaaggaaaaaaucucaaaaaaauuacacacaaagaucuaaggaaaauucuaggauuagcaccggaacaaaaaauauucggaguagaagaugaaagaauaguaaaaggaaaaaaagaaccacgcacauucguaccguuuuucuuucuugccgacauagccaaauuuaaagaauuguuugcaucaauacaaaaacacccugacgcuuuacaaauauuccgcgaauuagcagaaauauuacagcgaagcaaaacaccacaagaggcacuagaccgccugagggcacuaauggcgggaaaagguauagauacugacgaccgagaacuuuuggaacuauuuaaaaauaaaagaucaggaacaagagaauuaagccacagauauauccuagaagcccuuccauuauucuuagaggguuaugaugaaaaagaaguacaacguauccuaggcuuugaugauagagaggauuacucacgauauccaaaaucacuacgacaccuccaucuacgagaaggaaaccuauucgaaaaagaagaaaauccaauuaacaaccacgcgguuaaaagccuagccucuugggcguuaggacuaauagcugaccuaagcuggagauacggcccauucgaugaaauaauacuagagacaacaagggaugcucuaccugaaaagauuaggaaggaaauagauaaagcaaugagggaaagagaaaaagcgcuggauaagauaauaggaaaauacaaaaaagaauucccuucaauugacaaaagacuugccagaaaaauucaacuaugggaaagacaaaaaggacucgacuuguacucaggaaagguaauuaaucucucucaacuguuagauggaucagccgauauagaacauauaguaccacaauccuuaggagggcuaucaacagauuauaauaccauuguuacacuaaaaagcguaaaugcagcgaaaggaaauagauuaccuggagauuggcuggcagguaaucccgauuauagagaaagaauaggaaugcuuagugaaaaaggacuaauagacuggaaaaagagaaaaaaucucuuagcccaaucgcuagacgaaauauacacugaaaauacacauagcaaaggaauaagagcuacuagcuauuuagaggcauuaguagcacagguuuuaaaaagguauuauccuuucccagaccccgaacuccgaaaaaauggaauaggcguucgaaugauaccggguaaaguaaccucaaaaacacgaaguuuacuuggaauuaaaaguaaaucacgagaaacaaacuuccaccaugcugaagacgcuuugauauuaucaacacuaacaagaggauggcaaaauagacuccacagaauguuaagggauaacuacggaaaauccgaagcagaacuaaaagaguuauggaagaaauacaugccucacauagaaggccuaacauuagcagauuacauugaugaagcauucaggagauuuaugucaaagggugaagaaagccuguuuuacagagacauguuugacacaauaagaucaauaaguuauuggguagacaaaaaaccauuaucagcgaguucacauaaagaaacgguguauucaucaagacaugaagugccuaccuuaagaaagaauauacuagaagcauucgauaguuuaaaugucauaaaggaucgacauaaacugacuacggaagaauuuaugaaaagauaugauaaggaaauuagacaaaaauuaugguuacaccgaauagguaauacaaacgaugagaguuaucgcgcugucgaagaacgagcgacacagauagcacagauccucacacgcuaucaauuaauggacgcucagaaugauaaagaaauagaugaaaaauuccaacaagcacuaaaggaauuaauaacaucaccaauugaaguaacagggaaacucuugcgcaaaaugagauuuguguacgauaaacuaaaugcaaugcaaauagacagaggauuaguagaaacugauaaaaauaugcucggaauacauauaaguaaaggcccaaacgaaaaauuaauauuuagacgaauggacguaaacaaugcacaugaacuucaaaaagaaagaagcgggauacuaugcuaucuuaacgaaauguuauucauauucaauaagaaaggacuaauucauuauggaugucuaagaaguuauuuggaaaaaggccagggauccaaguauauagcuuuauuuaacccacgauuuccagcaaauccaaaagcacaacccucaaaauuuacuucggacaguaagauaaagcaagucggaauaggaucagcuacaggcauaauuaaagcucacuuagaucuagaugggcauguaagauccuaugaaguauuuggaacacuucccgaaggaucuaucgaaugguuuaaagaagaaagugguuauggacgaguagaagacgacccccaccacuga

SEQ ID NO: 5149 - RNA, 3402 nt, Artificial Sequence
  Cas9 variant
auggauuuaaauuauagaauaggacucgacaucgguauagccucagucggcugggcaguacuagaaaacaauucaaaagaugaaccaguuagaauugucgaccuaggaguacgccuauuugaagcagcagaagugccgaaaacuggagcagcuuuagcugaaccucgaagggaagcuagaacuacuagaagaagauuacgcagacgaaaacauagauuagaaagaaugaaaugguuacuacaagaauacggguuaauacaaacggaagaguuuaugaaacgauaucacagcgcaggucuacccgacgucuauagguuaagauacgaaggacuagagagaaaacuaaaagacgaagaacuagcgcaaauauuaauucauauagggaaacauagaggcuuucgcuccacaaggaaagcagaacuaaaagacaaaaacgauaaagagacuggugcuguauuaucagcaaccagagaaaacgaaaaacuaauggaggaacauggcuaucgaacggcaggagaaaugauuuacaaagacgauaaauuuagaacgggcugcacauggaaagaagaaggauauagauuaacaccuagaaacaaagaaggagauuauaaaaauacgaugcuaagagcauuauuagaggaugagguuaaagucauauucgauugccaacgaaaauuugguaaucaaaaagcaucagaagaacuggaaaaagcauauuuagcaauaaugacaucacaaagaaguuucgauaugggacccgggaaacaaccugauggaagugcaaguccguaugccauggaagguuucggugaccgaguaggauuaugugcacuagaaccacgagagaaacaagaaccaagagccccaaaagcagccuauaccucagaauuguuuguagcauuacagaaaauaaaucauuuacgcaucacagagaaaaauggaaaaggcagaggauuaacaagcgaagaaagagaaagacuuagcgaccuacuacauaaaaagaaagaauuaacuuacggcgcaguaaggaaagaauugcaauuagaccuacgauauagguuuaauacuuugaauuacucuagcaagaaaaugacugaagaagagaaaauaaaagaugccgaaaaagccaaauucguaucaaugguaagccacuaugaauauagaaaaagaaugagcgguauguuagaacaauuaucaccagaagaacaagccgaccuaauggaugaaguagggaaaaucuuaacauuauacaaaaaugacgauacaagaucuagagaauuucaaaaauuaggacuagauucugaaauaacagaagaacuuuuagaacuaaauccaagaggauuucaacauguuucucucaaagcuaugaagaaauuaaugccauauuuaaaagaaggauuaacuuaugacaaagcaugugcagaagcuggauaugacuuccaaggaaguguacaaaaagaaaggaguagacuacuaaaaggaaaagaaauaacugauauaauaaaugauauaaacaauccuguaguaaaacguucagucagucaaaccguuaaaguaauaaaugcuauuauacaaaaauauggcucaccacaagcagugaauauagaauuagcucgugaaaugucaagaaauuaugaugaaagaaggaaaauggagaaacaaaugaaagauagacaaucagaaaaugaaagagcaaagaaagaaauucaagaauuaggaaaugccuuuccaacuggacaagauauacugaaauacagauuguggcacgaccaggaugguauuugcauguacagcgccaaaagaauaccacuggcagaacucuuuacaggagcuuaugacauagaucauauacuaccauacagcauaacuuucgacgauucauacaggaacaaagugcuaguuacaagugaagaaaauagacaaaaagggaaucgaauaccuuaugaguauuucggaucagacucagaaagauggagcaaauucgaaacauuagucaauucaagaauuagagauuaccgaaaacaacaaaaucuccuaaaacagucauucacagaggaagaaagaaaagaguuuaaacagaggaauuuaaaugauacaaaauauauaacuaggguuauuuacaauaugauuagagagaacuuagcuuuagcaccauauaacucaccgggaaagaagaaacaaguguuugcaguuaacggagggguuacagcauaccuuaggaaacgcuggggaaugucagcaaaagauagaaguauagauacacaccacgccagagacgcuguuguaauagcuugcugcaccgacggcaugauacagaaaauaucucggaauauucaaggucgcgaacuauuauacgcccgaggguuuacagcaguggacguagaaaccggagaaaaauuuacgagggaugauuuuaccagagaucaaugggaugagauauuuggaguacaaguaccaaaaccaugggaguauuuuaaugaagaacuugacauacgacuaggagaaaauccaguugaguucauagaaacucauagugaugucagccgaaaacuagacuaccccgcaugguuuuaugaaaauaauauaauaagaccaguuuuuguaucaagaaugccuaaccgaaaaguaacaggagcugcacacgcggauacgauuagauccccaagacauuaucaagaaacagguaguguacuaacaaaaacagcauuaauagauuuaaaacuaaauaagaaaacgggagaaauagaaaacuacuauaaaccugaaagugauacacuauuauauaaugcacugaaagaacgacuagaacuuuauggaggugacggaaagaaagcguucgaagaaccauucuacaaaccgaaagcagauggaucucgaggaaauuugguaagaaaagugaaaaccuaugacaaacuaacccuagguguauacgucaauagucaacaugguaucgcagccaaugcaaaugguucuaugguuaggguagauguauucagaguuuccgggaaauacuacuuugucccaguauauauagcggacguaguacgcaaacgauuaccaaugaaagccgucguacaagguaaacaauacauagacuggaaagaaauggaagauaaagauuucauauuuucauuguacacacgcgauuuaauuucuuucaaaaguaaaaacggcaagaaaguaacaugcguagauggaaccucaaaagccgugaaugaagagauaguauacuauuacggagcgaacauuucaacagcaucauuuaguggaaaaucacacaacggaaguuucgaauuuacaucauuaggaauacaaggauuagaauacuuaaagaaauaccaaguggauguuuuaggaaauguaucagaaguaaaaagggagaaaagaaugggcuuuagauga

SEQ ID NO: 5150 - RNA, 3402 nt, Artificial Sequence
  Cas9 variant
augggaggcuucgaaguggaccgaaaaauauccuuagggcuagauauagggguuucaaguguaggauacagcguaauugacguugauaccggaaaaguacuugaauuaggaagccgccucaucaacggaaaaauaggaacagaaaaccaggcaagaagagaaaugagaggaacaagacgccucauaaaccgaaaaaaacaaagaaggaaagacacagugaaacuauuuaaugaguucaaacuaauugacucaaaaaaagaugaacacuacuuugaccacuuugcaaacaacagugaccccuaugaauuacggguaaaagguuuaagugaaaaacuuucgcucagcgaaauagcugacggguuauaucauauaguaaaacggagaggcauaaguuacgacuuaaaagacgcugacgaagaauccgaggggucagaauaugaaaauggucuaaaaaucaacaauagcgaauuaaaaaaccaaacaccggcacaaauacaacuaaaacgacucaaugaauacggagcaauucguggaaaaguaguaauagacgaagaaaaaauccucuuaaacgucuucccaaccaaagcauauuuagaugaagccaaaagaauuauugaaaaacaaagagaauucuauccaggcauucugacugaagaauucgaagaaaaauauugucagauacuaaccaggaaacgagacuauuucguagguccuggcuccgaaaaaagccgaacagacuacggaaucuacaaagaagacgguagaaccuuaaacaauuuauucgaagaacuaauaggccaugacaaaauauacccagaagaacuaagagcaagcggagcuagcuucacagcacagcuauuuaacguauuaaacgaucuaaacaaccugcauaucucaucauacgaggaccaaaaauuaacuacagaaaauaaagaacaaaucauaagcgaguuaaaguccacuacaaguaauguaaauaugaugaaacuaauacaaaaaaucgccggaugugaagaaagugacauaucaggcuacagaacagauaaaaacuauaaacccgaaaucucaucuaugaggauauaccgaaaaguacauaagaaacuacuagaaagugagaucgauaucacgaauuggccggacgacuucauaaacaaauuaaguuuuauauuaacacucaacacugaaaauggagaaauaagaaaccaacucaaaaacagauuacaaccagaauaugacuuccuaacagacgaacuuauacaaaccauaauagacaauaaagaaaguuucgauauaaaaucaaauaauaaauggcauagauucucaauaaaaaccauggaacuacuaauaccggaaaugauaaaaaggccaguggaacaaaugacacuaauaaaugaaaugggauuaauaaaaaauuccggaaaaaaguuuucaaauuacaaauacuuaccuuacaagaaaauagcagaagacauauauaacccuguagcgucgaaaagcguaagagaagcacuaaaaauaguaaaugcaauccuaaaagaauauggacauaucgaauauauaguaguagagaugccuagagacaaaaacgaggaugaagcaaaagaccaaauagaaaaauuucaaaaagccaauggacgauuaaaagaugcagcacuugaagaauuuacagaagcaauuggagacaagagcaccgucgauaaaaaacuaggaguccauagaucuaaauuacuauucaaaauacgauuaugguaccaacaaagaggaauggacuuauaugaagggaaaccaauaucggcaguagaccuacuaaacaacccagauucauuccaaauagaucacauaauaccacagagcguaagcuucgaugauucauuuaacaacaaaacacuauguaacagcggauuaaaccaaaucaaagacaaaaaaaccccguucgaauauaugaacgaaggcuauggucaaggauucgauuccaugaaagcuauggugaugaaaaauccacgaauagaccacaauaaacguaaaaauuaccuauuuagugaaaauguaagcgacaucgaaacuagaaaaagauuuauaucccgaaacuuaguagauacgagauaugcaagcagaguuguguuaaacaauuuacaagaauucuuuaaagaaaaagaauccgacaccaaaauaucaauaauaagaggcaaauucacaagcaaccuacgaaaacacuggaaaauaaauaaaaacagagacacguaucaccaucacgccauagacgccacaauuauagcagcaacaccauuucuaaauaucuggaaaaaaggcucaucaaucuuuccaagcaauguagagagugaagacuucuuugauaucaagaccgggaaaauaauaggaaaugacgaauucaauaaauacgcauaugacgaacccuauaauggauuuuauaaugaauuaagaaaugcaacagacagaauaaaauucagucaccaaauagauaaaaaaaugaacaggaaggucagcgauagcacaauauacaguacacgcguagcaaaaucaccaaaaaauaaaaaagaaagcgaguauauaguggcaaaaauaaaaaauaucuaugaugcugaugaauacgcaaaauucaaacgaaucuacgacaaagacaaaacaaaauucuuauuaaacaaauaugauccaagaaguuuuaaccaucuagaaaaaauaaugaauacauacccugacucaauagaaagaacaaugucuaauaauaaaguaaaagugguaagaauuaguccauucgaacucuauagacaagaccauggaccugugaaaaaauauagcaaaaaaaacaacggacccgaaauaaaacaacuaaaauacuuagauaaaaaagucgguaguucaauagacgucacaccugauaacgcaaagaauaagcaugucauucuuaaaucgcucaagccauggagaacagacaucuauuuaaaccaugaaacaggagaauacgaaauaaugggaauaaaauauucagauuuaaaauucaauaaaggagaagguuacggaauuaaaaaagcaaaauauuuagagaucaaacauagagagaaaguuagcgacgacucagaauucauguucacacuuuacaaaaaaaacagaauaaagguagaaaacauggagaccgaugaaucuguagaaaugcuauucuggucacgaacaauggauagucagaaaggauaugcagagcucaagccuauuuacaaauacaaaacagaagacgauaacuggccaauauacggaaacgcaaaaaaacaaauaauuaaaaaacuaauacccaaaaacugcaaaaucuggaaaguaaauacagacguacuaggaaauccauuuuacguagaaaaagaaggagaauacccaaaagacguauuagacuga

SEQ ID NO: 5151 - RNA, 3405 nt, Artificial Sequence
  Cas9 variant
augaauggccuaguacuaggacuagacaucggcaucgcaagcguaggcguagggauacucgagaaaaacucaggcaaaauuguucacgcuucaucgagaaucuuucccgcugcaacagccgauaacaaugucgaaagaaggaaaaaucgacaagcacgaagacuucaucgacgaaagaaacauagaggagcaagacuuaaagaccuauucgaauauuaugguuuauuaacagauuuuaguaaaguaucuauaaacuuaaacccuuaucgacuuagaguagacggauuagaccaacaacuuacuaaugaagaacuauuuaucgcacuuaaaaauaucguaaaacgcagaggaauuagcuaccuagaugacgcuagcgaagauggaggaacugucucaucagacuauggaaaagcaguagaagaaaauagaaaacuuuuagccgaacaaacacccggacaaauacaacucgaaagauucgaaaaauacggccaauugagaggugauuucacuguaguagaaaacagcgaaaaaugccguuuaauaaauguauucagcacaagcgcauauaagaaagaagcggagagaauacuacgaaaacaacaagaauuuaacaaucaaauaaccgaugaauuuauagaggacuacuuaaaaauacuaacaggaaaaagaaaauacuaucacggaccaggaaaugagaaaagcaggaccgacuauggacgcuuuagaaccgauggagcuacacuagacaacauauucggcauacuuaucggcaaauguacauuuuacccuaaugaauaucgagcgucgaaagcaucauauaccgcacaagaguucaaucuucucaacgaucuuaauaaucuuacagucccaaccgaaaccaagaaacuauccgaagaacaaaagaaaacuauaauagaauacgcaaaaucagcaaaaacccucggagccaguacauuacucaaauacaucgcaaaaaugauagacgcgucgguagaccaaauaagaggguauagggucgaugucaacaauaagccggaaaugcacacuuucgaaguuuacagaaaaaugcaaucacuugaaaccauaucagugggagaacuaucgagaaacauucuagacgaauuagcccacauauuaacgcuaaauacagaaagagaagguauagaagaagcaauaaauaccaaacugagagauagcuuuucacaggaucaaguacuggagcuaguucaguuuagaaagaacaacagcucauuauucagcaaaggauggcauaacuuuucauugaaauuaaugauggaauuaauaccagaacuauacgaaacuagcgaagaacaaaugacaauacuaaccagacuagguaaacagaaaaguaaagaaacaagcaaaagaacuaaauauauagaugaaaaagaaguaacagaagagauauauaaucccguaguagcuaaaucaguaagacaagcaauaaaaauaauaaacgaagcaacuaagaaacauggaauauuugauaauaucgugauagagauggcaagagaaaacaacgaagaagacgccaagaaagacuacauaaaacgccaaaaagcuaaccaagaugaaaaauaugcagcaauggaaaaagcagcauuucaauacaauggaaagaaagaauuaccagauaauauauuccauggucacaaagaauuagcuaccaaaauuagacuauggcaucaacaaggagaaaaaugccuauauacaggaaaaucaauaccaaucagugaucucauacacaaucaauauaaauacgaaauagaccacauccuaccacuaucacuaucuuucgacgauagccuaagcaauaaaguacucguucuagcuacagcaaaucaagaaaaaggacaaagaacccccuuucaagcgcuagacagcauggacgacgcauggagcuaucgugaguucaaaagcuacguaaaagaaagcaaacuauuagggaauaaaaagaaagaauaccuguuaaccgaggaagauauuucaaaaauagaaguaaaacaaaaauucaucgaaagaaacuuaguugacacucgcuauaguuccagaguagugcuaaacgcccuucaagacuucuacaaaaaccauaauuucgauacaacuauaucagucgucagaggucaauuuacaagccaauuaagaagaaaauggggacuagaaaaaucccgagaaaccuaccaccaucaugcaguagaugccuuaauuaucgcggcuagcucacaacuaagacuguggaagaaacaaaauaauccucuaaucgcauacaaagaaggacaguucguugauagucaaacaggcgaaaucauaagucuaacggacgaugaauacaaagaauuaguauuuaaagccccauaugaucacuucguagauacacuuagcaguaaaacuuucgaagacaguauauuauucagcuaucagguugauucaaaauuuaacagaaaaauaagugacgcuacaaucuaugcaacacgaaaagcaaaacuagacaaagagaagaaagaauauaccuacacuuuaggaaaaauuaaagacauauauagucuggguacaaaaacacccucaaaaacaggauuuuacaaauuuuuggaucuauacaauaaagauaaaagccaguuccugauguuccaaaaagaccguaaaacaugggacgaagucauagagaaaauuauggaacaauauagacccuuuaaagaauaugacaaagccggcaaauuaguugauuuuaacccauucgaaaaauauaggcaagaaaauggaccaauccgaaaauacagcaagaaagggaacgguccggaaauuaaaagucuuaaauacuacgauauacuacucggaaaacauaaaaacauuacucccgagggaucuaggaauacaguugcauuacuaucacuaaauccauggcguacagacguauacuauaacauggaaacaaagaaauaugaguucuuagggcuaaaauacgcagaccuuccuuuugaagaagggggugcauacggaauauccacagaaaccuauaaugaauuacgagaaaaagaagggauagguaaaaacucggaguucaaauucacgcuauauaaaaacgaccuaauacuaauaaaagauacugaaacaaacugccaacaauucuuuagguuuuggucaaggacuggcaaagacaacccaaagagcuucgaaaaacacaaaauagaacuaaaaccauaugaaaaggcaaaauuugaaaaaggagaagaacuugaaguucuaggcaagguaccacccagcucuaaucaauuucagaaaaauaugcaaaucgaaaacuuaucuauuuauaaagugaaaacagauguauuaggaaacaagcauuucauaaagaaagaaggagauaaaccgaaacuaaaauucuga

SEQ ID NO: 5152 - RNA, 3405 nt, Artificial Sequence
  Cas9 variant
augaauggcuuaguauuaggccucgacauaggaauagcgucugucggaguuggaauccuagagaaaaacuccgggaaaauaauucacgcaaacucacggcuauucccagccgcaaccgcugacaauaauguagaaagaagaaagaaucgccaagcucgaagacucaacagacgaaagaaacaccgaggcguacgauuccaagaccuauucgaagacuauggacuacuaacagauuucaguaaagucagcauuaacuugaauccguauagauuacgaguagacggacuaaaccaacaacuaacaaaugaagaauuauucauugcccuuaaaaauauaguaaaacgccguggaauaucauauuuagacgacgccagcgaagacgguggagcaguaaguuccgacuacgguaaagccguugaagaaaauagaaaacuccuagcagaacaaacgccaggccagauucagcuagaaagauucgaaaaauauggacaaguaagaggagauuucacgguaguugaaaacggcgaaaaacuacgacuaauaaaugucuucucaacaucugcauauaagaaagaagcagaaaggauccuucgaaaacaacaagaguucaauaaccaaauaacagacgaguucaucgaagauuacuuaaaaauucuaaccggaaaaagaaaauacuaucacggaccuggaaaugagaaaagcagaacagacuacggaagguuuagaacagauggaacuacacuagauaacauauuugguauacuaauagguaaauguaccuucuaccccgaagaauaccgagcaaguaaagcaucauacacagcgcaagaguucaaccuucuaaacgaccuaaacaauuuaaccguaccaaccgaaacaaagaaacuuagugaagaacaaaagaaagucauuguagaauacgcaaaagaagccaaaacccuaggagcauccacguuacuaaaauacauugcuaaaaugauagaugcaucaguugaccaaauuagaggauacagaguagacguaaauaacaaaccggaaaugcacaccuucgaaguauauagaaaaaugcagagcuuagaaacuaucucggucggcgaauuaucaagaaauguauuagacgaauuagcacacauacuaacauugaacaccgaacgagaaggaauggaggaagcaauaaacacaaaacuaaaagauucuuuuagccaagaucagguacuagaguugguccaauuccgcaaaaacaacuccagccucuucucaaaaggguggcauaauuucagccuaaaauuaaugauggaacucaucccagaacucuacgaaacuucagaagaacaaaugacaauucucacccgauuagguaaacaaaaaucuaaagaaacaucaaaacgaaccaaauacauagacgaaaaagaacuaacugaagagauuuauaauccagugguagcgaaaagcgucagacaagcaauaaaaauaauaaaugaagcaacgaagaaacauggaauauucgacaacauaguuauagaaauggcacgagaaaacaacgaagaagacgccaagaaagacuacauuaaacgacaaaaagcaaaccaagacgagaaaaaugcugcaauggaaaaagcugccuuccaguacaacggcaagaaagaacuacccgacaacauauuccacggacacaaagaacuagccacaaaaauacgacuauggcaucaacaaggagaaaaaugccuauacacaggaaaaacgauacccauuagugaucuaauucauaaucaauacaaauacgaaauagaccauauccuaccccuaucacuaucauuugaugauucuuuaucaaauaaaguacugguacuggcgacagcuaaccaagaaaaaggacaacgaacacccuuucaggcacucgauucaauggacgacgcauggucuuauagagaauuuaaaagcuacgucaaagaaaguaaauuauuaggaaacaaaaagaaagaauacuuacuaacugaagaagauauauccaaaauagaaguaaaacagaaauucauagaacguaaccucauagauacacgauacucauccagaguaguacuaaacgccuuacaagacuucuauaaagcccacaaauuugacacuacuaucucaguuguacgaggccaguucacgucacaacuacggagaaaaugggguuuagagaaaagcagagaaaccuaucaccaucacgcagucgacgcacuaauuauagcugcgucaucacaacuacgacucuggaagaaacaaaacaacaguuuaauauccuacaaagaaggucaauucguggacagcgaaacaggugaaauuaucucauuaacagacgacgaauacaaagaacuuguauucaaagcacccuacgaucauuucgucgacacgcuacgcucaaagaaauucgaagacucaauccuauucucuuaccaaguagauucaaaauucaaccgcaaaauaucagacgcaacaauauacgccacuagaaaagccaaauuagacaaagaaaagaaagaauauacauauacacuagguaaaauuaaagacauauauucauuagggacgaaagcuccauccaaaacagguuuuuacaaauucuuagaccuauacaacaaagauaaaucacaauuuuuaauguuucagaaagacagaaaaacaugggaugaaguaauagagaaaauaauggaacaauauagaccauucaaagaauaugauaaaacaggaaaacugguagacuuuaauccauuugaaaaauacagacaagaaaauggaccaaucaggaaauacuccaagaaagggaauggaccagaaauaaaaagucuaaaauacuacgacauacuacuaggaaaacauaaaaauauaacaccagaaggaagucgaaauacgguggcucuacuaucccuaaaccccuggagaacugacguguauuacaacauggaaacgaagaaauaugaauuucucggacucaaauacgcagaccuaccauuugaagaagguggugcauauggaauaucaacagaaacuuauaaugaauuaagagaaaaagaaggaauagggaaaaacagcgaguucaaauucacauuauacaaaaaugauuuaaucuuaauaaaagacacugaaaccaauugucaacagauauuuagauuuuggagccgaaccgggaaagauaacccaaaaucguuugaaaaacacaaaauagaauuaaaaccauacgaaaaagcaagauuugaaaaaggagaagaacuuaaagugcuaggcaaaguucccccaagcaguaaucaacuacagaaaaauaugcaaaucgaaaacuuaaguauauauaaaguaaaaacugacgucuuaggaaacaaacacuucauuaagaaagaaggugaugaaccaaaacuuaaauucuga

SEQ ID NO: 5153 - RNA, 3405 nt, Artificial Sequence
  Cas9 variant
augaacggccuaguauuaggacuagauaucggaauagcaaguguaggaguaggaauacuagagaaaaacucuggaaaaauaauacaugaaaacaguagauuauuccccgcugccacagcggauaauaauguagaaagaagaaagaacagacaagcacgaagacuaaacagacguaagaaacaucgcggagucagauuucaagaccuguuugaagacuauggacucuuaacagacuucagcaaaguaucaauaaauuuaaacccauaccgacuacggguagacgggcuuaaucaacaacuaacaaaugaagaacuguucauagcccuaaagaauauuguuaaacgaagaggaauaaguuaccuagaugaugcuucggaagauggaggcacaguaccaucagauuauggaaaagcaguaaaagaaaacagaaaauuauuagccgagaaaacacccggccaaauacaacuagaaagauucgagaaauacggucaacuacgaggugacuucacgguagaagaaaacggagaaaaaugucgucucauuaacguauuuagcaccucagccuacaagaaagaagccgaaagaaucuuacgaaaacagcaagaguucaacaaucaaauaacaaacgaauuuauagaagacuacuugaaaauacucacaggaaaaagaaaauauuaccacgguccagguaacgaaaaaucucgaaccgauuauggaagauuuagaaccgauggcacaacacuggauaauaucuucggcauucuuauaggaaaauguacauucuaccccgaggaauauagaguaagcaaagcgucauauacugcacaagaguucaauauccuaaaugaucucaacaaccuaacggucccaacugaaacaaagaaacuaagugaagaacagaagaaagauauagucgaauaugcuaaagaaacaaaaacacucggagcaagcaccuuauuaaaauacaucgcaaaaaugaucgacgcaucaguagaccaaaucagaggauaucgaguagacguaaacaauaaacccgagaugcauacguuugaaguauaccgcaaaaugcaaagucuagaaacaauuagcgucggagaguuaucaaggaacguacuagacgagcuugcacauauacucacacuaaauaccgaaagagaaggaauagaagaagcuauaaacaccaaacuaaugggagucuucucacaagaccaagucuuagaauuagugcaauucaggaaaaacaauaguagccuuuucucaaaaggauggcacaacuucucuuugaaacucaugauggaauuaauaccagaacuauaugaaacaagugaagaacaaaugacaauacuaaccagacuaggaaaacaaaaauccaaggaaacuagcaaaagaacuaaauacauagacgagaaggaaguuacagaggaaauauauaauccuguuguagcaaaaucuguaagacaagcaauuaaaauaauaaacgaagccaccaagaaauaugguaucuuugauaacaucgugauagaaauggcaagggaaaacaaugaagaagacgcaaagaaagacuacauaaaaagacaaaaagcaaaccaagaugagaaaaaugcagcaauggaaaaagcagcuuuccaauauaacggcaaaaaggaauuaccugauucgauauuccauggacacaaagaacuggcaaccaaaauacgcuuauggcaucaacaaggagaaaaauguuuauacacaggcaaaaacauaccaauaucagaccugauacacaaucaauacaaauaugaaaucgaccacauacuaccgcuaucccuuaguuuugacgacucccuauccaacaaggucuuaguacuagcgacagccaaccaagaaaaaggacaaaggacaccauuucaagcacuugacagcauggacgaugcuuggagcuaccgcgaguucaaaagcuaugucaaagacucaaaacuccuuucaaacaaaaagaaagacuaccugcuaacagaagaagauauuucgaaaauagaaguaaaacaaaaauucauugaaagaaauuuagucgacacacgauacucaucaagaguaguacuaaacgcacugcaagauuucuauaaagcacacaaauuugauacuacaauuucaguaguaagaggacaguucacaagucaacuaagacggaaauggggauuggaaaaaucgcgugaaacguaucaucaccaugccgucgacgcauuaauuaucgcggccagcagccaauuaagauuguggaagaaacaaaauaauccccuaauaacauauaaagaaggacaauucguagauagcgaaacuggcgaaaucaucagccuaacagaugacgaauacaaagaauuaguuuucaaagcaccauacgaucacuuuguagacacgcuaaggucaaaaacuuucgaagacucuauauuauucucauaccaagucgacucaaaauucaacagaaaaauuucagaugcaacaauauacgcgaccagaaaagccaaacuggacaaagaaaagaaagaguauacguacacacuuggcaaaauaaaagacaucuauagccuagguacuaaaacacccagcaaaacaggauuuuauaaauuucucgaccuauacaacaaagacaaaucacaauuccuaauguuucaaaaagacagaaaaacgugggacgaaguaauagagaaaauaauggaacaauacagacccuuuaaagaauaugauaaaacaggaaaacugguugacuuuaauccauucgaaaaauaccgacaagaaaacggaccaauauguaaauauucaaagaaaggaaacggaccagaaauaaaaucacuaaaauauuaugacauacuacuaggcaaacacaaaaauaucaccccagaaggcucaagaaacacagucgccuuacucucacucaaucccuggagaacggauguguacuauaacauggaaacuaagaaauaugaauuuuuaggacuaaaauaugcagaucuaccuuucgaaaaaggaggagccuauggcauaucaaccgaaaccuacaauaaacugagagaaaaagaaggaauagggaaaaacagugaguucaaauucacacuguauaaaaaugaucuaauacuaaucaaagacacagaaaccaacugccaacaaauauuuagauucuggucacgaacagggaaagauaauccaaaaucauuugaaaaacacaaaauugaauuaaaaccauacgaaaaagcccgauucgaaaaaggagaagaacuagaagucuugggcaaggucccaccaaguagcaaucaauuucagaaaaacaugcaaauagaaaaccuaagcauauauaagguaaagacagacgugcuaggaaagaaacauauaauaaagaaagaaggagacgaaccaaaauuaaaauucuga

SEQ ID NO: 5154 - RNA, 3405 nt, Artificial Sequence
  Cas9 variant
augaaguacaucgaaucaguaaguaucggauuugacauaggagucggaagcguaggauacgcagugaucaauucaaaaacaaaacaaauacucgaaagcgggguuuccauauuucccgcugccgucgcacaaaaaaacgucgaaaggagagaaucuagacaaagucgacgacuacgacgccgaagaguuaacagacuaaacgacuuaaagaaacuacuaaaaaaaaacggauuuauccccagcccaaauaaaaacccauacgaaauuagaguacgaggauuagagcaccaacuaucaagagacgaaauagcuauagcaguuuuacacauagcaaaacgaagaggcauaucauacagccuagacgauguaguagacgaaaacgucacagauuucaaagguaaaaucgcuaaaaaccaagaggcauuaaaaaauaagacucccggagaaauacaauacgaacgacuucucaaauacggcaaaguaagaggcacaguuacaaacuacguagaauaugacgaacaaccagaauacuuucugaauguauucccaaacuccgccuauguagaugaagcaaaaagaauacucacuugccaaaaacaauauuaccccgagaucacagacgaucuaauagaaaauauagucaaaauuauaucuagaaagagagcauacuauaucggaccaggaaacgaaaaaucaagaacagauuacggaauuuaccgaacaaauggagaaacacuagaaaauaucuuugaaauucuuauagggaaagacucgguuaacccugacgaauuaagagcaccagcuaacucccuaacagcacaaguauacaacuuacuuaacgacuuaacaaacauacgauacaauggaucagaaaggcuaacuccagaacaaaaacaagauauucuuucugagcuuuuaacaacugaaaaaacaguucaaaugcuaaauguaaucgcaaaaaaaguaaaugugaaaaaagaagaaauaagcgguuucagaacaaaaaaagaugauaaaccagauuuccacacacucgaaguauauagaaaaguucgcaaacauaugcucaacaaagggaucgauauaaaugaguggccaacugaaugcuucgacgaacuagcauuuaucuucaauuuaaauacagaaauaggggaaauaagaaauagaauauccgagaaaguugugcccaaauacgacuuuauaacaaaucaaauaguggaugauuuacuagaagaccccaaaauuuuugccauaaguacaucacaaaaauggcacagauucucuauuaaaacaaugaauguacuaaucccagaacucuuaaacggguauaaugaacaaaugacuaucuuaacgagaaugggacucuuggaagauucuaaaaacgacuacaguaauauagacaagauagacauaaaaaacgucacagaaaauauuuacaauccuguaguaagaaaaucaaucaaaaaaugcuuaaagauuuuuaaugaacuauacaaaaaauaccccaauauaucagacguagucauagaacuacccagagaagauaacccagaagacgcaagaaaacuaauaaaaaaaaugcaaaaagaaaaucugguagaaaaagauacuucacuagaagcauuccgcaaagaggcaaaucucucggaaaacggauuaauagauuuuuuaagaaaagguaaaaaccgagcuuuaaaaaucagguuaugguaccagcaagaaggcaaaugucuauacacuggagaaccaauacuagccgaggaccuuugcaaaaacgaggcaaauuacgacauagaccauauuauacccaucucagucucauucgacgacucaaucaauaacaaaguacucugcaguagucacuuuaauagauucgaaaaagaaaaaaaaacaccguucgaauacuucucgaacaaaucaucccacuuagguagauacucuaauuuugacgaauuucgagcaucgguuaacgcuaauaaacgaauaucagaugucaaacgaaaaaaucugcuaucaaaagaauuauuaagugaucucgacacacgcaaaaaauucauagcgcgaaacuuaguagauacuagauacgcaucgagaguaguguuuaacgaacucacacaauuuuuugcaaguaaaaaagccgacacuaagguugcaguaauuagaggaaaauuuaccucgcaacuacgacgagcuuggcaacuaaacaaaucuagagauacauaucaccaucacgcaguagaugcugcauuaauugggguaacacccuuucuuaaaauauggagaucagguaaaaccauuuacccaagaaaaaugacagaagcccagacagacuuugaacucaacgaaaucacaacaaacgacgaauuuaaagaaagcuacuaccaauuaccuuguccacaauuucuggauuaccuuacccaaaugcaagaaaacuuaaagauaaacuuugaaguugacaaaaaaaugaaccguaaaaucuccgaugcuaugauuuauucaucacgaaaaaaaaaacuaucaaaagacaagaaagaaaaagaauacucacucggaacaauuaaugacauuuauuccgaugcaggauauagcaaauuuaaaaauauauacaaaaaagauaaagaaaaauuccuaauguaucaccuagaccauaaaucauucgaaauccuagaagauauaauaucccaauacccugauaaagaggaauacaucgacucggaaggcaaaguaaaacaaagggcaguuucaccauucgaaaucuacaggcgaaaauaugguuacauacguaaguacucuaaaaaaaacaacggacccaucaucaaaaacaugaaauacuauaaugaaaaccuaccaaaaauauacauugauauaaccccgaaacaaucgauagacaaaaaaguuuaucuuacaaauauaucgccauggagaacugauguuuacuauaaccgaagucaaaauucauaccauauaaugggaauuaaauauagcgauuugagauacaucgacgggaaauauggaauaccuaaaaacguuuacgagaaaaucaaacuaagagaaaaaauaccuucagaaucagaauuuugcuucucgcucuauaaaaaugauagaguaaaaauaauagaucccaauaaaaaugaggaaauagaacuaagauucaauucacgcacacuaccaagcguacuaaauuaugucgaauuuaaaccauuauuccaagaaagcuauaacucucuaacgcuacuaccaguauucucaaaaacaacgagcgaaggacgcauaauuaaaaaauucacgcgagaagacaauauuguauacaaaguaaauacagacgaacuagggaacccauacuacauacuuaaagaaucacaaaacccaaaaaacauaaucgauaacucaaacaaaaccgaauga

SEQ ID NO: 5155 - RNA, 3405 nt, Artificial Sequence
  Cas9 variant
augaauggacuuguacugggcuuagacaucggaauagccucagaaggagucggaauauuagagaaaaauucagguaaaaucauacaugcaaacaguagacuauucccagcagcuacagccgacaacaauguagaaagaagaaagaacagacaagccagaagauuaaauagacgaaagaaacacagaggaguaagauuccaagaucuguuugaagacuacggucuacuaacagacuucucaaaaguauccaucaaucuaaauccuuaucgcuuacgaguugauggauugaaccaacaauuaaccaacgaagaacuauuuauagcauugaaaaauauuguaaagagaagaggaauaagcuauuuagacgacgcaagcgaagacggaggagcaguaucgucugacuauggaaaagccguagaagaaaacagaaaacuacuagcagaacaaacucccggucaaauccaauuggaacguuucgaaaaauacggacaagucagaggagacuucacaguagucgaaaauggcgaaaaauuacgcuuaaucaauguuuucagcacaucagcuuacaagaaagaagcagaacgcauccuacggaaacaacaagaguucaacaaucagauuacagaugaguucauagaagacuaccugaaaauacuaacaggcaaaagaaaauauuaccacggacccggaaaugagaaaagcagaacagacuauggaagauuccgaacagacggaacaacauuggacaacauauuuggcauccuaauagguaaauguacguuuuacccagaagaauauagagcuagcaaagcaucuuacacagcacaagaguucaacuuauuaaacgaucuaaacaaccuuacagucccaacggaaacaaagaaacuaagcgaagaacaaaagaaagucauaguagaauacgcaaaagaagcaaaaaccuuaggcgcuagcacauuacuaaaauauauagcgaaaaugauagaugcaagugucgaucaaauaagaggauaucgggucgauguaaacaacaaacccgaaaugcacacauuugaaguuuauagaaaaaugcaaagucuagaaacuauuucagucggagaacuuucaagaaacguacuagacgaacuagcacacauacuaacacuuaacacagaaagggaagguauggaagaagcaauaaauacgaaauuaaaagacagcuuuucccaagaucaggucuuagaacuuguacaauuuaggaaaaauaauucaagccuauuuucgaaaggauggcacaacuuuucauuaaaacuuaugauggaacucauuccggaacucuacgaaaccucagaagaacaaaugacgauacuaacacgccucggaaaacaaaaaucaaaagaaacaaguaaacgaacuaaauauauagaugaaaaagaauuaacagaagaaauauacaaucccguuguugcaaaaucaguucgacaggcaauaaagaucauuaaugaagccacaaagaagcauggaauauucgacaacauuguaauagaaauggcucgagaaaacaacgaagaagaugccaagaaagauuauauaaaaagacaaaaagccaaccaagaugagaaaaaugcagcaauggaaaaagcagcauuucaauacaacggcaagaaagaauugcccgacaacauauuucacggacacaaagaacuugcaaccaaaaucagacuauggcaccaacaaggugaaaaauguuuguacacgggaaaaacaauaccaauuagcgacuuaaucuauaaucaauacaaauacgaaaucgaccacaucuuaccacuaagccucaguuucgacgacucacuaaguaauaaaguccuagcauuagcuaccgcuaaucaagaaaaaggccaacgaacuccauuccaagcacucgauucaauggacgacgcauggaguuauagagaauuuaaaucauacgucaaagaccuuaagucauuaagcaacaagaagaaagacuaucuccuaaccgaagaagauauaucaaaaauagaagugaaacaaaaauucauagaacgaaacuuaguagacacuagauacagcagcagaguuguguuaaaugcucuacaagacuucuauaaaucccaccaauuugauaccacaauaagcguuguaaggggacaauuuacaucacaauuacgccgaaaauggggacuugaaaaaucaagagaaacuuaucaccaucaugcuguagacgcauuaauaaucgcagcaagcucccaacucagauuguggaagaaacaaaauaacccacugauuacauauaaagaaggacaauuugucgacagccagacuggugaaaucaucucucuuaccgaugacgaauacaaagagcuaguauuuaaagccccauacgaccacuucguugacacucuauccaguaaaacguucgaagacucaauauuauuuucauaccaaguagauagcaaauucaacaggaaaaucagugaugcaaccauauacgcuacaagaaaagcaaaauuagacaaagaaaagaaagaauauacauacacguuaggcaaaauaaaagacauauauagucuggguaccaaaacaccaaguaaaacaggcuuuuacaaauuucucgaccuauacaacaaagacaaaucgcaauuccuaauguuucaaaaagaccgcaaaacaugggaugaaguaaucgagaaaaucauggaacaauacagaccuuucaaagaauacgacaaaacagguaaguuagucgacuuuaacccauucgaaaaauaccgccaagaaaaugaaccgauaagaaaauacucaaagaaagguaacggcccugaaaucaaaagccuaaaauauuacgacauacuucuaggcaaacacaaaaauauaacacccgaaggcucacgaaacacaguagcauuacuaaguuuaaauccauggaggacggacguauacuacaauauggaaaccaagaaauacgaguucuuaggccucaaauacgcagaccuaccauuugaagaaggaggugcauacggaauaucaacagaaacauacaaugaauuaagagaaaaagaaggaaucggcaaaaauucugaguuuaaauucacauuauacaaaaaugaccuaauauuaauuaaagacacugaaacuaauugccaacaaauuuucagauucuggagucgaacaggaaaagauaauccuaaaaguuuugaaaaacacaaaaucgaacucaaaccguacgaaaaagcacgauucgaaaaaggagaggaacuagaaguacuaggaaaaguaccgccaagcuccaaccaacuccagaaaaauaugcaaauagaaaaccuauccaucuacaaagucaagacagauguacucgguaauaaacauuuuauaaagaaagagggagauaaaccgaaauuaaaauucuga

SEQ ID NO: 5156 - RNA, 3408 nt, Artificial Sequence
  Cas9 variant
augagcgaucuaguccuuggucuagacauagguauaggcucaguagguguaggaauuuuaaauaaaguaaccggcgaaauaauacauaaaaauucaaggauauuuccagcagcacaagcugaaaauaauuuggaaagaagaaccaaccgacaagggagaagacuaacaagaagaaagaaacaucggaggguacgacuaaaccacuuauuugaagaaucaggacucaucacggauuucacaaaaguaagcauaaaccugaacccguaccaacugagagucaaaggacucacagcagaacuuucaaaugaagaauuauucauagcacucaaaaacaugguaaaacaccgugguauaucauacuuagaugaugcaucagacgauggcaacagcagugucggugauuaugcccaaauagugaaagaaaacucuaaacaacuagaaacuaaaacaccuggacaaauccaacuggaaagguaccaaaaauacggccaauuacgcggagacuucacagucgaggaagauggccgcaaacacagacuaaucaacguuuuuccaacaagcgccuaccacgccgaagcgcuucgcauauuacaaacacaacaagaguucaauccccaaauaaccgaugaauuuauuaauuccuacuuagaaauucuaacagguaaaagaaaauauuaccacggaccaggcaacgaaaaaucacgaacagauuauggaaaauacaccacuaaaaaggaugcacaaggacaauacauaacccuaaauaacauauucgggaucuuaauagguaaauguacauuuuauccagaagaauacagagcggccaaagcuagcuauacagcccaagaauuuaaucuauuaaaugaucuaaacaacuugacaguacccaccgaaaccaagaaacucagugaagaacaaaaauaucaaauaauaacauacgugaaaaaugaaaaagccauggguccagcaaaacuuuucaaauauauagcaaaacuauuggccugugacauagcugauaucaaaggauacagaauagacaaauccgacaaagcggaaauucauacauucgaagccuauaggaaaaugaaaacacuagaaacuauagauauagaacaaauagaaagagaaaagcuagauaaguuagcauauguacugacacuuaauacugaaagagaaggcauucaagaagcacucgaccaugaguucgcagauggaacauuuucacaagaacaaguagaugaauuaguacaauuuagaaaagcuaauagcucaauauucggaaaaggauggcauagcuuuucagucaaacuuaugauggaacuaauaccagaacuauacgccacuucugaagaacaaaugacaaucuuaacucgacuggggaaacaaaagacaacaucaucuagcaacaaaacuaaauacaucgacgaaaaacaacuuacugaagaaauauacaaucccguagucgcaaaaucaguaagacaagcuaucaaaauaguaaaugcggcaaucaagaaauacggcgauuucgacaacaucguaaucgaaauggccagagaaacaaacgaagaugaugaaaagaaagcuauacagaaaauacaaaaagccaacaaagccgaaaaagacgcagccaugaggaaagcagcgaaccaauauaauggaaaagcagaacuaccccauaguguauuccauggucacaaacaacuggcaacaaaaauacgacuauggcaccaacaaggagaacguugcuuauauaccggcaaaacuauauccauacaugaucuaauaaauaaccccaaccaauuugagaucgaccauauucuaccgcuaaguaucacauucgacgacuccuuagccaacaaaguacucguuuacgcaaccgcuaaccaagaaaaaggacaaagaaccccauaucaggcuuuagauucaauggacgacgcuuggucauuccgagaacuaaaagcauuuguccgcgaaucuaaagcacuaagcaacaaaaagaaagaguaccuauuaaccgaggaagauaucucuaaauucgacguaaggaagaaauucauugaaagaaaccuuguggacacuagauaugcaucccguguaguacuaaaugcucuacaagaacacuucaaagcacacaaaauugacaccaaaguaucaguaguacgaggacaauucacaucacaacucagaagacauuggggaauagacaaaacuagagauaccuaucaucaccacgcggucgacgcacuaauuaucgcagccucaagucaacuaaaccuuuggaagaaacagaaaaacacucuaguuuccuauucugaagaccaacuucuugauaucgaaacaggugaacucauaucagacgacgaauacaaagaaucaguuuuuaaagcacccuaccaacauuucguugacacauuaaaaagcaaagaauuugaagacaguauacuuuucucuuaucaaguagacuccaaauuuaaccguaaaauauccgacgcaacaauuuaugcaacaagacaagccaaaguaggaaaagauaagaaagaugaaacauacguauuagguaaaauaaaagacauauacgcuuuaggaacaaaaacucccucaaaaacaggauuuuauaaauuccuugaucucuauaacaaagauaaaagucaauucuuagucuaccaaaaagaucgcaaaacgugggacgagguaauagagaaaauaauggaacaauacagaccauucaaagaaagugauaaaaauggaaaagaagucgauuucaaccccuucgaaaaauaucgaaucgaaaauggaccuauaagaaaauauuccagaaaaggaaaugguccugaaauaaaaucacuaaaauauuaugccuccaaacuuggaaaccacauagacauuacaccaaaagacucaaacaacaaaguuguccuacaauccgucaguccauggcgcgcugauguauauuuuaauaaaacaaccggcagcuaugaaauacuaggcuuaaaauacgcggauuuacaauucgaaaaaggaacaggaacauauagaauaagugaagaaaaauacaacgauauuaaaaagaaagaaggagucgauucagacagugaguuuaaauuuacucuauacaaaaacgaccuacuccuuauaaaggauacugaaacaaaagagcaaagacuauuucgcuuccuaagucgaaguaugccaaacaagaaacacuauguagaacuaaaaccauacuccaaagacaaauucgagaaaaacgaauccuuaauagaaauacucggaucugcagacaaaagcggaagauguaucaaaggucuugcuaaauccaaccuuucaaucuuuaaagucagaacagauguauuaggcaaucaacauauaauuaaaaacgaaggcgacaaaccgaaauuagauuucuga

SEQ ID NO: 5157 - RNA, 3408 nt, Artificial Sequence
  Cas9 variant
augggaguaauauuuuuguacgaaaacauuguuaaacccuuuccaucacgauacgacaaggccaucaugaaaagauuaaaaggaagacaaacaaugggguauauacuuucuuuggauauuggaauagccucuugcggguacaguguccuagagacagaugcuuuaggaguaccauauaaaauaaaaacacugaauagcauaaucuucacacgagcagaaaauccuaaaacaggcgccaguuuggcugaacccagaagaaaauaucguggggcaagaagaagaaaacgaagaacaaguuuccgaaaacacaggacuagacaauuauucauaacauccgguuuguuauccaaacaagacauagcaagauaccuaaaucaacaagaaccucacgacgauauaugggaauuaagaguaaaaggauuagaugaaccacucaccaaccuacaacuauuccaaguauuauacuacuuugucacacacagaggauucaaaucaaacagaaaagcagaacuaaaagauaaagauauaggacccguacuaaauaguauaaacgcauucaaagaagaaaugcaaucacacgacuauagaacaauaggcgaacuauacgccaaugauccaagauuucgugaucgaaaacauaauaaagauuauacaaacggcuuucuaggaacgauacaaagaucaugguuaguggaugaaauuaaaauguuauuaacgaaucaacaaucauuugguaacacucagcuaacaagcgaguucauagaauuauacuuaaacauauucacuucucaaagaaauuuugaugauggaccugccucagguccauacucaggagauuuaaucgauaaaaugguaggaccggacaccuucaauagaagcagaaaacgcgccccaagagcgacauauacguuccaauauuuuucguuucuaaguaaauuaaauagcuuacgaauagcaccaucuauuucagcaccauuugaaacucucacaguugaccagcgcgcucuaauaacaaaacgccuaugggguccagacguuaaauccgcagauuuaaaauucaaacaaauuaggaugguguuaagccuaccugaaacagcaagauuuaaucuuguaaauuacggaaauacacccgaaaaagcccuagaaaucgaggacaaaaccacuuucauuucgauuaaaccacucagagaaauagaaaaagcacuaacaggaacaacacuaccagucucacacgaucaacucgacgcaauagcaagaauauuaaccguauauaaaucagauucuaacagaaaaaccgcauuucacaaccaaacuguauugucagacgaaguuaucgaacaacugcucccucuuaauuucucaaaguucggccaccucuccguugaaacgaugcaagagaucauuccauacuuagaacaaggcaugguauauucugaugcugcuacugccgcuggauacgacuuuagaaacaaucaaauagacauggaauauaucagagauaacgucacuaauccagucguuaggagagccguuagcguagcaaauaaacucguaaaagcuguagugagacgauacgguaaaccugauucaauacacauagaacucgcuagagaccuaucccaaaacuuccaagaaagacgccaagacgaaguucgacaacagaaaaaugcuagggacaaugagaaaauagcaaaaagacucgaggaacuuggaauacccguaaauggaguaaauaucacuaaaaugaaacuauacgacgaacaacaugguauagaccuguaugaccuuucuacgaacgcaucaauggcagucacagauauauuuagugacgauagauacgaaauagaccauauaauacccuacucagucaguuuugacgauucuuauacaaacaaagucuuaguaucagcaaaagcaaauagagagaaaagagaccgaauaccaauggaaguauucggaaaugauucagaaagaaggagacaauuugaaaaucgaguuaacacaaacauaaccaaccuaaggaagaaaagaaacuuacuaaaagaaacguuuagcgacgaagauaaagcuaaauggaaaagucggaauauaaacgauacacgguacuuaaauagaauacuaaugaacuacuuaucccaaaauguagaauuuacggacgugcuaucugaugcuaaacacguaaucgcucuuaauggagcaguaaccgcaaaaauaagaaguagauggggaauaacaaaaguaagagcagcuggcgaucuacaucacgcaguugacgcagucguaaucggcugcguaacggacgcguuaauacaagccguaacucgauaugcaaaauaccaagagagaagagauaauaaagcagcagcugaacaggaucuggcagagaacaauccagaagaacucgacgccaaacaauuuagaaagguauuuaaugauuacccucuaccguggccagaguuccgggaagaauuaaugggucgcguaucuagugacccaucgcaaauaauggcaggucgacaguggucacacuauacagcagaggaaaucagugaauugaaacaaccauucguuguaaggguaccgaaucaucgaauaguaggcccagcaacauuagacacaguauauggacagcccaauccagacgauggccuaauaacacaaagaguaaggauaaccgacuuaaaaccccagaaaaacaaagacggugaagacauaauaaaagcaggagcuaauguuuacgaacuagcggccgaugguggcaauaaacuuguauaugaaaguaucuuagacgcacugcaaguagcgggaggagaugguaagaaagcauuuccaacaggcagacuucuaguuagaucgccaauucaagauauuccaguagaaagaguaagaguuacuucgaaagcgacucuagucguucccguaggcccaaaaagugucgcggcaaaugguucgauggucagaauagaugucuauaaaacuccuaagaaauauguauucguuccaauauaugugagagacacaguaaaagcagaauuacccgauagggccguagcaccugucaaaccguauagucaaugguaccaauuacaaccaaaagaccaauucuuauucucgcuauuugcuaaugacuuaauaagauuuaaacacccaagaggaguuaguacaaaagaaauucuaacugacgguucacaagaaaagggaaaaagaacagauguagugggauauuuuacaggagccgauauagcaacagcgaguauagcaauagagggaccagaccguucuuuuucagcgcguggaauuggauuugcaaguuuaaagaacguggaaaaacuuacuguaaacuacuucggagagcuucauucagugcacgaaacacaaccaaugcaauucagaggacaaagaggauga

SEQ ID NO: 5158 - RNA, 3411 nt, Artificial Sequence
  Cas9 variant
augaacggccuaguacugggauuagacauaggaauagcuagcguuggaguagguauacuugaaaaagauacuggcaaaauaauacaugcuucaucaagacuauucccagcugcaacagcagacaauaacguagaaagaagaaguaacagacaaggcagaagauuaaauaggagaaagaaacacagaagcguacgcuuacaagaccuauuugaaucauacggauuauuaacugauuucucgaaauuaucgauuaaucuaaaccccuaucaacuuagaguacaaggaauggaaaaucaauuaacaaaugaagaacuauuuauagcacucaaaaacauagucaaacgacgagguauuucguauuuagacgacgccuccgaagacggggguacaguuuccagcgacuacgguaaagcaguagaagaaaacagacgacuacuaacagagaaaaccccaggccaaauacaacuagaaagauucgaaaaauauggacaguuaagaggugauuucaccguagaagaaaacggagaaaaacgaagauuaauuaacguguuuucaacuucggcauaccgaaaagaagcugaaagaauacuacgaaaacaacaagaguucaacaacaaaauaacggaugaguucaucgaagacuaucuaaccaucuuaaccggcaaaaggaaauacuaucacggaccggggaaugaaaaaucuagaacagauuauggcagauuuagaacugauggcacuacacuggacaacauauuuggcauauuaauuggaaaaugcaccuucuauccugaagaauacagagccuccaaagcgucuuauacagcacaagaauuuaauuuacuaaacgaccuuaauaaccuaacaguaccaaccgaaaccaagaaauuaagugaagaacagaagaaaacuauaauugaauacgcgaaaucagcaaaaacuuuaggcgcuucgacauuacuaaaauacauagcuaagaugauagacgcaagcguagaucaaauacgaggauaccgaguagacguaaauaacaaaccagaaaugcacacguuugaaguauaccgaaaaaugcaaucacuagaaacuaucaaaguagaagaauuaccgcgaaaaguauuagacgaacuagcccauauacugacacuaaacacagaaagagaagguauagaagaagccauuaacaguaaauuaaaagauacauucaaccgugaucaaguacuggaacuuguacaauucaggaaaaauaacaguucacuauuuagcaaagguuggcacaauuuuucguuaaaacuaaugauggaacucauuccugaauuauaugaaacgagcgaagaacaaaugacaauuuuaacgagauuaggaaaacaaagauccaaagaaacaaguaaaagaacaaaauacauagaugaaaaagaacugacagaagaaauauauaaucccgucgucgcgaaaucaguuagacaagcaauaaaaaucauaaaugaagcgacaaagaaauauggaaucuucgacaauauugucaucgaaauggcaagagaaaacaaugaagaagaugccaaaaagaauuauauuaaacagcaaaaagcaaaucaagaugagaaaaacgccgcaauggaaaaagcggcauuucaauauaacgguaagaaagaacuuccagacaauauauuccaugggcauauggaacuggcaacaaaaauaagauuauggcaucaacaaggggaaaaaugccuauauacaggcaaaaacauacaaaucagcgaccuuauacauaaccaauacaaauacgaaauagaucauauacuuccccucagcuuaaguuucgaugacaguuuaucaaacaaaguuuuagucuuagccacagcuaaccaagaaaaagggcaaaggacaccauuucaagcacucgauagcauggaugacgccuggucauacagagaguucaaaucauacguaaaagaaaguaaauuacuuggcaacaagaagaaagauuaucuccuaacugaagaagauauaagcaaaauagaagucaaacaaaaauuuauugagaaaaaccugguggauacaagauacagcagcagaguagucuuaaaugcguuacaagacuuuuauaagaaacaucaguucgauacgacaauauccgucguaagaggacaauucacgucccaacuaagaagaaaauggaaacucgagaaaaguagagauacauaccaucaucacgcaguagacgcacuaauuauagcagcaaguagccaacuacgccuauggaagaaacauaacaaucccuugaucucguacaaagacggacaauuuguagauagugaaacaggagaaauaguaucauuaagcaaugaagaauauaaagaauuaguuuuuaaagcuccauaugaccacuucguagauacacuaagaagcaagaaauuugaagacucaauacuguucucauaucaaguugacagcaaauacaacagaaaaaucagugacgcaacaauauacgcuacaagaaaagccaaacuagacaaagauaagaaagaauacacuuauacacuagguaaaaucaaagauaucuacgcauuaggaacaaaaaccccuucaaaaacaggcuucuauaaauuccuagaucuauacaaaacagacaaaagccaauuucuuauguaucaaaaagauagaaaaacaugggacgaaguuauugagaaaauaaucgaacaauaucgcccguuuaaggaauacgauaaaaacggcaaagaaguugacuuuaaccccuuugaaaaauacagaauagagaacggaccuauaagaaaauauucccgaaaaggaaacggaaguguaauaaaauccaugaaauauuaugacaaccuacucgguaaauucguagacauuacuccaucggaaagcaaaaaccccguggcacuuuuaucauuaaauccauggaggacagauguauacuauaauccagaaaccagaaaauacgaguuucuaggacuuaaauacgcagauuuauguuuugguaaaggaggcucuuacgguauaucagaaguaaaauacaacaaaauaagagagaaagaggggaucggcaaagaaucagaauuuaaauuuacacuauauaaaaacgaucuaauacuaauaaaagauacagaaacaaacugucagcaauuuuucagauuuugguccagaacaggaaaagauaaccccaagagcuuugaaaaacauaaaauagaauuaaaaccuuacgaaaaagcaaaauuugaaaaaggagaagaacuagaaguauugggcaaaguaccgccaucaucuaaccaauuccagaaaaacaugcaaauagaaaaccucucgauauauaaaguaaaaaccgauguacucggcaauaaacacuuuaucaagaaagaaggagacgaaccaaaacuaaaauuuaagaaauga

SEQ ID NO: 5159 - RNA, 3411 nt, Artificial Sequence
  Cas9 variant
augaauggccuugucuuagguuuagacauaggcaucgcaaguguaggggucgggauacugaaaaaagacacgggagaaauaauacauacuaauucucgacuuuucagcgcugccacagcugauucaaacauagaaagaagacgacaucgcggcgggaagagacuuacaagacgaaaaaagcacagaucuauuagauuacaugauuuguucgaagauucuggauuauuaacugauuuuagcaaaguaucaauuaacuugaauccauaccaacuucgaguucaaggcuuagacaaccaacuuaccaaugaagaacuauucauagcucucaaaaacauaguaaaaagacgagguauaucauaccucgacgaugcuucugaagacggcggcacaguaucaucagauuacggcaaagcagucgaagaaaauagaaaacuccucgcugaacaaacaccgggacaaauacaauuagacagguuugaaaaguacggacaaguaagaggcgacuucacaguuguagaaaacggcgaaaaaagacgacuaauuaacguauucacaacuucagcauauagcaaagaagcagaaaggauauugcggaaacaacaagaauucaauaagaaaauaacagacgaauucaucgaaaauuauuuaacuaucuuaacggguaaaagaaaauauuaccacggaccuggcaacgaaaaguccagaacagauuacggcagguauacaacaaagaaagacccugaaggaaaguacauaacccuagacaacauauuugguauacucauaggcaaauguacguucuacccggacgaauaucgcgcgaguaaagcaagcuauacugcacaagaauuuaaucuauuaaacgauuugaauaauuuaaccguacccacggaaacaaaaaaauugagugaagaacaaaaaaaaacaauaauaaaauacgcgaaaacagcaaaaacacuaggagcuucuacacuacuaaaauauauagccaaguuaauaggagcauccguagaucagauccauggauaccgaauagaucccaacaaaaagccugaaaugcauaccuuugaaacuuauagaaaaaugcaaaguuuagaaacaauuaguguagaagaaauaccaagaaaagucuuggaugaguuagcacacauauuaacccugaacacagaaagagaaggaauagaagaagcaauaaaugccacccuaaaagacacauucagucaagaccaaguacuagaauuaguccaauucagaaaaaauaacucaucauuauuuuccaaaggauggcacaacuuuucuuuaaaguuaaugauggaguuaauaccagaacucuacgaaacaucagaagaacaaaugaccauccucacgcgacucggaaaacaaaaaagcaaagaaacaaguaaaagaacaaaguacauugacgaaaaagaauuaacagaagaaauuuacaacccuguaguagccaagaguguccgacaagcgauaaagauuaucaaugaagcaaccaaaaaauaugggauauuugauaauauaguaauagagauggcaagggaaaacaaugaagaagacgcaaaaaagggauacaacgaaaggcagaaagccaaucucgacgaaaaaaaaucggcgauggaaaaagccgcauuucaauacaaugguaaaaaagaacuaccagacaacguuuuccacggacacaaagaacuagcaacuaaaauaagguuauggcaccaacaaggagaaaaaugcuuauauaccggaaaaaacauaccaauuucggacuuaauccaaaaccaauacaaauaugaaauagaccacauacuaccauuaaguuuaucuuucgaugacucucucucaaauaaaguacuaguacuagccacagcaaaucaagaaaaaggacaaagaaccccuuuccaggcacuagacagcauggacgaugccuggaguuauagagaauuuaaaaguuacguaaaagacuuaaaacuacuaagcaauaaaaagaaagacuauuuacuaacagaagaagauauaucaaaaauugaaguaaaacaaaaauuuauagaaagaaacuuagucgacacacgcuacucaaguagaguaguauuaaaugcgcuacaggacuuuuauaaagaacaucaauucgauacaacgaucucaguaguuaggggacaauucacgucacaguuacgaagaaaauggggacuagaaaaaucaagagaaacauaucaucaucaugccgucgacgcucuaauaaucgcugcgucaagucaacucagacuauggaaaaaacaaaacaacccacuuauuucauauaaggaaggccaauuuguggaucaagagacaggugaaauaauaucacuaagcgacgacgaauauaaagaacuaguauucaaagcaccguacgaccauuucguagacacucucaaaucaaaaaaauucgaggauucaauccuauucuccuaucaaguagauucuaaauacaaucgcaaaauaucggaugccacuauauacgcaacacguaaagcuaaacucgauaaagaaaaaaaagaauacacauauacacucggcaaaauaaaagauauauacgcacuggguucagaaaaacucaaaacgggauuuuacaaauuccuucaucucuauaaaaaggacaaaagccaguuccuaauguaccaaaaagauagaaaaacgugggacgaagucaucgaaaagauacuagaacaauauagaccguucaaagaaaaggacaaaaaugguaaagaagucgauuucaauccuuuugaaaaauauaggauagaaaacgggccaauacauaaauacucaagaaaaggcaacggacccguaauaaaaucccuaaaauacuacgacaaaaacaucccagagucuuuuaucaauauuacacccaguaauucaaaaaauaaaguuauauuaaggcaauuaaaccccuggagaacagacguauacuucaaccaucaaacagaaaaauaugaacuauuaggcuuaaaauacgcccacuuacaguucgaaaaaaaaaccggaaauuacagcauaacaauagauaaauacaaugaaaucaaggaaaaagaaggagucucagaacagucagaauucaaauucacacuucauaaaaacgaucuauuauuaauaaaagacaccgaaacaaaagaacaacaacuauuccguuuccuauccagaacaaaaccuaacguaaaacacuauguagagcuaaagccauauaguagagacgaauuugaaaaaaacgaaagauugaucgaaauccucggcagcguagauaaaagcggaagauucguaaaaggauuagggaaaucaaaucuaaguauauacaaaguaagaacagacguauuaggaaaccaacacauaauaaaaaaagaaggagaagaaccaaaacuuaaauuuuga

SEQ ID NO: 5160 - RNA, 3411 nt, Artificial Sequence
  Cas9 variant
augaauggacuaguacuuggauuagauauaggaauagcuucaguaggaguaggcauauuagaaaaagacacaggaaaaauuauccacgccaguuccagacuauucccggcugcaacagccgacaauaaugucgaaagaagaucaaaccgacaaggccguagacuaaaucgcaggaaaaaacaucgaucaguaaggcuucaagauuuauuugaaggauacggacuauuaacagacuuuagcaaaguaaguaugaaucugaauccuuaccaauuaaggguacaagggauggaaaaccaacucacaaacgaagaguuauucguugcacugaaaaauauugucaagagacgagggauaucauacuuagaugaugcaagcgaagauggagggacaguauccucugacuacggaaaagccguagaagaaaaucgcaaacuucuugcagaaaaaacaccgggacaaauacaauuagaaagauucgaaaaauacggucaauuaagaggagauuucacuguagaagaaaauggagaaaaacaucgacuaauuaaugucuucucaacaucugcauacagaaaagaagcagaaagaauccuuagaaaacaacaagaauuuaauuccaaaaucacggaugaguuuauagaagacuaucuaauuauauuaacaggaaaaagaaaauacuaucaugggcccggcaaugaaaaaucaagaacagacuauggaagauucaggacagacggaacuaccuuagacaacauuuuugguauacuaaucggcaaauguacauucuauaccgaagaauauagagcaaguaaagcaaguuauaccgcucaagaauucaaucuacucaaugaccuaaauaacuugacagucccaacugaaacgaaaaaacucucagaagaacaaaaaaaauugauuauagaauaugcaaaaucugcaaaaacacuaggugcaaguacucuccucaaguauauugcuaaaaugauagaugcuucagucgaccaaauacgcggauaccgaguagacguaaacaacaaaccagagaugcacacguucgagguauacaggaaaaugcaaagccucgaaacaauaaaaguagaagaauuaccgaggaaaguuuuagacgaacuagcgcacauacuaacuuuaaacacagaaagagaaggaauagaagaagcaaucaauagcaaacuaaaagacauauuuaacagagaccaaguacuugagcucguacaguucagaaaaaauaauaguucucuauuuucaaaaggauggcacaauuucucuaucaaacuuaugauggaacuaauacccgaauuguacgaaaccagcgaagaacaaaugacaauacucacaagauugggcaaacaacgcaguaaagaaacaucaaaaagaacgaaauacauagacgaaaaagaauuaacugaagaaauauauaacccaguuguugcaaaaucaguaagacaagcaauaaaaaucauaaacgaggcuaccaaaaaauacggcauuuucgacaacaucguuauagaaauggcccgagaaaacaaugaagaagacgcaaaaaaagacuauaucaaacgacaaaaggccaaccaagacgaaaaaaaugccgccauggaaaaagcggcauuucaguacaauggcaagaaagagcuaccagauaauauuuuccauggucauaaagaacucacaacaaagauccgacuuuggcaucaacagggagagaaaugcuuauauacugggaaaaacauaccaaucuccgaccuaauccauaaccaauacaaauaugaaauagaucauauacucccauuaaguuuaaguuucgacgacaguuuaucuaacaaaguacuaguacuggcaacugcaaaccaagaaaaaggacaacguacaccuuuccaagcccucgauucaauggacgacgcauggucuuacagggaauuuaaaucuuacgugaaagauucaaaguuacucagcaacaaaaaaaaagauuaucuauuaacagaggaagauauaagcaaaaucgaaguaaagcaaaaauucauagaaagaaacuuaguagacaccagauacucaucaaggguaguucucaacgcacugcaagacuuuuauaaaagccaucaauuagacacaacuauuucagucguuagaggacaauucacgagucaacuacgcagaaaauggggaaucgaaaaaaguagagaaacguaucaccaccacgcgguugacgcacuuaucauugcggcaaguucucaauuacgauuauggaaaaaacacuccaauccacuaauagcauauaaagaaggacaauuuguagacucagagacaggagaaauaguaucacuaucagacgaagaauacaaagaacucguuuucaaagcgccauacgaccauuuuguagacacucuaagaucuaaaaaauucgaagacaguauauuauucucuuaccaaguagacagcaaauauaaccgaaagauaucugaugcuacuauuuaugcaacgaggaaagcgaagcuugauaaagaaaaaaaagaauacacuuacacacuaggaaaaauaaaagacauauacgcccucgguacaaagacacccuccaaaacuggcuucuacaaauuucucgaccuauacaaaacagauaaaagccaauuccuaauguaccaaaaagacagaaagacaugggaugaaguaauagaaaagauaauagaacaauacagaccuuucaaagaauaugacaaaaauggcaaagaagucgacuuuaauccauuugaaaaauacagaaucggaaacgguccaauacgcaaauacucuaaaaaagggaacgguccagaaauaaaaucacuuaaauacuaugacauacuacuaggaaaacauaaaaauauaacaccugauggcucgcgaaauaccguagcauuacuuucacucaauccuuggcgaacggaugucuacuacaacucagaaacuaaaaaauacgaauuucuaggacuuaaauaugcugacuuaugcuuugaagaagguggagcauauggaauaucagaaguaaaauauaaaaaaauuagagaaaaagaaggcauaggaaaaaauucugaauuuaaauucacacuauauaaaaacgaccucauacuuauaaaagauacggaaacaaacugucaacaauucuuuagauucuggagcagaacagggaaagacaaucccaaauccuuugaaaaacauaaaauugaauuaaaacccuacgaaaaagccaaauuugaaaaaggagaagaacucaaaguacugggcaaaguuccgccauccagcaaccaauuucaaaaaaacaugcaaauagaaaauuugucaauauauaagguuaaaaccgacaucuuaggaaacaaacauuuuaucaaaaaagagggagaugaacccaaacuuaaauucaaaaaauga

SEQ ID NO: 5161 - RNA, 3420 nt, Artificial Sequence
  Cas9 variant
augucagaccuuguucuaggccucgauaucggaaucggaucuguaggcguaggaauauuaaauaaaguuaccggggaaauaauccauaaaaauaguagaauauucccagcugcacaggccgagaacaacuuagaaagaagaacuaauagacaaggcaggagauuaacacgaagaaaaaaacaucgacggguuagacucaaucauuuauuugaggaaucagguuuaauaacagacuucacaaaaguaucgauaaacuuaaaccccuaucaauuaagaguaaaaggauuaacagcagaauuaaguaacgaagaauuauucauugccuuaaaaaacaugguuaaacaccgaggaaucucauaccuagaugacgcaagcgacgacggaaauagcuccguaggggauuaugcgcaaauaguaaaagaaaacucaaaacaacuagaaaccaaaacgcccgggcaaauccaacuagaacgauaucagaaauauggucaauugagaggagauuucacaguagaagaagacggcagaaaacacagacuaauaaacguuuuuccaacaucugcguaccacgcagaagcacuacgcauccuacaaacucagcaggaauucaacccacaaauaacggacgaauucaucaauucuuaccuagaaauauuaacggggaaaagaaaauauuaccaugguccaggaaacgagaaaucacgcacagauuacggaaaauauacaacaaaaaaagaugcgcaaggacaauauauuacacuaaacaacauauucgguauccuaauagguaaauguacguuuuauccagaagaauacagggcagcaaaagcaaguuauacagcacaagaauuuaauuuacuuaacgaccuaaauaauuuaacaguaccaacagaaacaaagaaacuuucagaagaacaaaaguaccaaauaauaacauacgucaaaaacgaaaaagcaaugggacccgcaaaacucuucaaauauauagcaaaauuauuaucaugugauguagcugauaucaaaggauaccgaauagauaaauccgacaaagcggaaauacacacauuugaagcuuaccggaaaaugaaaacuuuggaaacccuagacgucaaaaaaauggcccgagaagaauuggauaaauuagcauacguacuaacucuaaauacagaaagagaaggcauacaagaagcccuugaccaugaauuugcagaugguaccuucucacaagaacaagucgaugaacugguccaauucagaaaagcuaacucuucaauauuugggaaaggauggcauucauuuaguguuaagcuaaugauggagcuaauaccugaacuauacgcaacuagugaagaacaaaugaccauacuaaccagacuaggaaaacaaaagaccacuaguuccucaaacaaaacaaaauacauagacgaaaaacaauuaacugaggaaauauauaaccccguaguagccaaaagugugaggcaggcaaucaaaauagucaacgcagcaauuaaaaaauauggagauuuugauaacauaguaauugagauggcuagagaaacaaaugaagaugacgaaaaaaaggcaauacaaaaaauacaaaaagcgaauaaagcagagaaagaugcagcaaugagaaaagccgccaaccaauacaacggcaaagcagaauuaccccacucaguauuucaugggcauaaacaauuagcaacaaaaauucguuuauggcaucaacaaggugaacgaugccuuuauacaggaaaaaccaucucaauacacgaccuaauaaacaacccaaaucaauucgagauagaccacauuuugccacuaaguauaacauucgacgauagcuuagcuaauaaaguccuaguauacgccaccgcaaaucaggaaaaaggacaaagaaccccauaccaagcauuagacucuauggacgaugccuggagcuuccgggaacugaaagcguucguaagagaaaguaaagcuuugaguaacaaaaaaaaagaauaucuacuaacggaagaagauaucucaaaauucgacguuagaaaaaaauuuaucgaaaggaacuuaguagauacaagauaugcuucacgcgucguacuaaacgcacuacaagaacacuuuagaacucauaaaauagacacaaaaguaaguguaguacgaggacaauucacaucacaacuacgaaggcauuggggaauagaaaaaaccagagacacauaccaucaucaugcgguagaugcacuaaucauagcagcuagcucccaacuaaaccuuuggaaaaagcaaaaaaacaccuuaguuucauauucugaagaccaacuccuugacaucgaaacaggagaacugaucucagacgaugaauauaaagaaagcguauuuaaagccccauaccaacacuucguagacacgcuaaaaucaaaagaauuugaagacucaauccuauuuagcuaccaaguagacagcaaauucaaucgaaaaauaagcgaugcaacaauauacgcaacaaggaaagcuaaacuagauaaagaaaaaaaagaauauacguacacguuaggaaaaauaaaagacaucuacgcuuuagggacaaaaacaccaucaaaaaccggauuuuauaaguuucuagaucuauacaaaaaagacaaaucacaauuuuuaauguaccaaaaagacaggcgaacaugggaugaaguaauagaaaaaaucuuagagcaauacagaccuuuuaaagaaaaagacaaaaauggaaaagaaguugauuuuaacccuuucgaaaaguauagaauagaaaacgguccuauccggaaauauuccagaaaaggcaacgggccugagauaaaaucccugaaauauuaugauaaccuacuaggaagauuuguagacauaacuccuagcgaaaguaaaaacccagucgcgcuacuaucuuuaaacccauggcgaacugauguauacuauaauacagaaaccagaaaguacgaauuccugggcuuaaaauacgccgaccuauguuuugagaaagguggaucauacggaauaucuaaaguuaaauacaauaaaauacgagaaaaggaagguauagguaaaaauagugaguuuaaguuuacucuuuacaaaaaugacuuaauauuaauaaaagauacagaaacaaacagacagcaaauauuuagauuuuggucaagaacaggaaaagacaacccaaaauccuucgaaaaacauaaacuagaacucaaaccauaugaaaaaaccagauucgaaaaaggugaagaacuaaaaguucuaggaaaagucccgccaucaagcaacagauuacagaaaaauaugcagauagaaaauuuauccauauacaaagucagaacagauguacuaggaaaccaacacaucauuaaaaacgagggugauaaaccaaaacucgacuuuuga

SEQ ID NO: 5162 - RNA, 3420 nt, Artificial Sequence
  Cas9 variant
augaacuauuauaauggauucauaauaaccgaaaaugcaauggccucgaaacacgaaaauuugggcgcauuaacauuuggauuagacauuggaauagcuaguguagguugggcgguacuaggcgaaaaucgaauaauagauuuaggaguacgcuguuuugauaaagcagaaacugcaaaagaaggugaauccuugaacuuagcgagaaggacagcgagguuauuaagaagacgacuuaggagacgagcauggagacuuacaaaacuagcaagacuacuaaaacgagaaggauuaauagcagacacaaauguuuuucaaaaaccauucaacuugaaagaugcaaacgaaaaaggucuaaguuucuggcaauuaagaguagacgcuuuagacagaaaauuaagugcagaagaaugggcgagaguaaucuaccaccuaugcaaacaccguggauuccauuggaucagccgagcugaagaaaaagcagcagagggagauuccaagagcgaagguggaaaaguaaaacaaggauuggcaggaacuaagaaacuaaugcaagagaaaaauuaccgaacugccgcagaaaugguccucacagaauuuccagaagcccaaagaaauaaacaaggagacuauagcaaagcacuauccagaauacuacuaggagacgaaaugacucaauuauucaagcaucaacgagaacuuggaaacccacacgcaacagaaaaguuagaagcagccauacuaggaaauggagaccacaaaaguggacuauuuugggcccaaaacccagcauuagccggaaaugauuuacuaaaaaugcuaggacauugcacauuugaaaaagccgaauauagagucccaaaagcaucuuuuacagcugaaaggcauguuugguuaacuaggcuaaauaauuuaagaauugucguagacggaacaacuagaccauuaaacgaagcugaaaggcaucuggcccuuuuaaugccauaucaacaagccggugauuuaacauauaagcaauuacgaacagcauuaaccaaagcaggguauuuaccagaaaguuuucgauauacaggucuagcauaugcaucgggucaaaaagcggaugaaaaagcuaaagaccccgaaucagcaccuuuaguaaaacuuccggccuggcaugaauugagaaaaaccuuggaaaagaaagaauuagccuccgaauggcagaaaauuucauccgaugcacuugauggaaaaccacaauuacucgaucaaaucgccuggguauuaagcguauacaaagacgauaccgaaguugaggcagaacuaugcaaauuaaaucuaccaaaugcagagaaaaugauagaugcacuucuagauauacguuuugacaaauuuaguaaucugucgcuaaaagcacugagacaaauuguaccacuaauggaacaaggucaaagauacgacgaagcgguggcuaacauuccagaauauggccaucacucacaauuacaugaaguuggcgcgggugaacauaaauacuuaccaccauuuuauaaagaacgagauaaaacagguaggaugguauucaaugacgauauggauaucccacgaaacccuguugucuuaagagcauuaaaccaagcuagaaaaguaguuaacgcucuaauuaaagaauaugggaguccacacgaaguacacauagaaauggcgagagauuuaaguagaccacuugaugaaaggcgugaugucgaaaaauuacaaaaagaguuccgcgaucgaaaugaaaaagacaaggcuuuauucgcacaagauuuuaauauaguaggagcaguuaaaggcaaagaauuugaaaaauaucaauuauauagggaacaacaagggaaaugugcguauucuauagaaccaauggauauucacagguuauucgaacaaggauacguagaaauugaucaugcacuaccauauaguagaucauucgaugacagcaaaaacaacagaguauuaguccuagcaaaagaaaaucgugauaagggaaacagaacaccauuugaauauuuagggggcaaggacaacucagaaagguggcggcaguuuguagcauuuguagaagguaauaaaucauacagacuagcaaaacgaucuagguugcuaagaaaagacuuuggaaaggaugaagcaaaaggcuuuagagaaagaaauuuaaacgauacaagguauauauguagauucuuuaaaaauuacguagaacaauauuugcaacuucaugaagacagugacgcuaaacguugcguagucuuaucaggacaaaugacuagcuuuuuacgagcacguuggggauuaguaaagguccgaggagauucagacagacaucacgcccucgauggagcaauaguugcagcauguucacauucaaugguuaaacggcuuagugacuacucaagaagaaaagaauuagaacaaguaagggcagguuuuguagauguagacacgggagaaauuguuaauccagccauguuucaacaaguacaagagcauuucccaaauccuuggccacauuucagagaugaagucaaauuaagauuaaacguagaugacccagcucuguuacacucagaaaugaauagauuugguacuuauucaccagaagcauugaaggcuuuacgaccucuuuuuauaaguagagcaccacaaagaagaaauaguggcgcagcacacaaagauaccauauacgcacaaccagaaagauuaguugcucaaggugguguaacacaaaaaguaccacuaaccaguuuaacgcuaaaagauuuagacaaacuuaucgauccacauagaaaugaaaaauuauauucagcaauaagaauaaggcuagaacaacauggaggaaaaggagauaaagcauucccagcuucaaauccauuaagaaagccagauucggaaggcaaccccacaggccccauaguaaggggcguaacaauggucaucgauaagcucaguggaaucccaauacggggcgggauagcgaaaaacgauaguaugguccgugucgacguuuucaccaaagcaggcaaauuccaucuaguaccaguauacguucaucacgcaguagcgaaaguauugccaaauagggcugugguugcauauaaagaugaaacagaauggacuuuaauagacgauggauucgauuuuuguuuuucaauguacccuaaugaccuuuuaagaauaaaguugcguaaugcaagccaucuugguuauuaugcuucuugcaauaggagcacaggugcaauuaacuuauggagucaugacagaaaucaacagguuggcaaagacgggaugauagaaucaauaggggucaagacagcacuaaauguugaaaaacuaaauauagacguacuagggaauagguauccugcaccacccgaaaaacgaagagauuuagcuuga

SEQ ID NO: 5163 - RNA, 3423 nt, Artificial Sequence
  Cas9 variant
augaaaaacaugacaaaaguaaacgucggucuagacguaggaaucucuucugcaggcuggucagucaucaaugcagaaacaaaccaaauacuugaauccggaguccgacuuuucagcggaucagacgcagacgagaaugucaacagaagaaaccaacgacaaggacggagacuauucagaagaagaaaacuaagaauacaagaagcaaagaaauaccuugaaaacgucuuucaacuaaaagauauagaaccaaaagacgaauggaacccauacgaaauaagaguaagagcuuuaaaugaaaaaguaagcaaagaggaauugagcaucgcccuuuuaaauauaguuaaacauagaggaauaucauaugaacucgaagacguaacagaugaagaaggaacaaauacacaaucauuccaaucaggauuagauuauaacagaagacuccugaaaacaaaaacaguaggagaaauacaauaugaccgucuccagaaauauggucaagugagaggacaaauacagacagaggauggucuacuaauaaacaucuuccccacuaaaaacuacguagaagaaguagaaagaauauuagaaacacaaaagaaauaccaccccgaaauagacgacguguucauagagaaaauuaucagcuucguaacacgaaaaagagaauauuucgucggaccgggaaacgagaaaagcagaacagacuacggaaucuaccgggaaaacggugaaacacuagauaaccuuuuugaaauauugauaggcaaagauaaauucuacccagaagaauacagagcagcagguucaucguauacagcacaaauauuuaaucuuuuaaacgaccugaacaaccuaagaauaccuacaacagaagaucaucaccucacuaaagcccaaaaggaagaaauuauaaccgaacucaaaaacacaucaagacuaucaggaggaaugcuaaaauuaaucuccaaggucacaaaagccccaaaagaagaaauaucuggauacagaaaagacgaaaaagauaaaccagaucuccauucacuagccuauuaucgaaaacagaaaaauauguuagaaaaagaaggcauccaaauagcagauuuuagugaagaauuguuagacgaacuugcaacaaugaugacauuaaacacagaaccgggggaaauaagaaaacaauuaaacaaaauaacaaaccaauacgacauacuuacaccagaaguuauagaaguucuagucaaaaaucauacggcauuuguagcaacaucuaaucauaaauggcauagauuuucucuaaaauuaaugaaagaguucauuccagaacuacuagaaacgagcaaagaacaauccaccauccuaugcgagagaggauucauacaaaauagagcaaguuauuuagaugaaaaucaucacuuuaauuacgcagaauuacgcgagaaucuauauaacccaguaguaagaaaaucaacaugugaaauguugaaaguauucacagccauacaggaaaaauaccccaacauucaaaauguaauaguagagcuuccucgcgaaaccaacgaagaugaacaaaagagaaaaauaaagaaaauaaacgacaacaaugcaaaacgaaagaaagagauuuuaaaagaagcccaagcacaaucaggacucucugaagaagcucuugaagaaaaacuguugaaaacaaaaggacuauauuuaaaacucaugcuuugguaugaacaagaaggcaaaugcgucuauucaggacaagagauaccguuaucugaccuacugcaaaauaaagguggauaugaaguagaccacauuauacccauaaguauaucauucgacgauagguuauguaacaaaguucuaguaagacaacaacuaaacucucagaaaagcaaccaaacacccuucgaauauaugacaacacacacagauggacaccuaucuuuccacgaauuaaaagaauuagucgguaaaaacaaaagauucucaaaagagaaaagggaacuacuccuagcagaaauauacucaaacgacaucgaaacacgaaaacgauucauaaacaggaaccuaguggauacaucauacacagcaaggaucguauugaacgcccuucaacaauacaagaaagaaaaccaacuaagcaugaacguuagcguuguacgaggagcaaugacaaacauucuacgaaagaagguaaagcuagacaaaacaagggagacauuccaccaccacgcgauagacgcgagccuaauggcagucauaccaaacauugaguucuucaaagaacgaaaagaaugguuaccaaaaagcgcaaaugaagaaguaguagaaguagaaguuucugaagaagaaaccaugcccgaaaaagaauuuaaaguaaaaaugagauuaccggaaaguuucauccaagaugugcaaauacuacaacgaaacagcuucgcaaaagaagaaguaagcggaccacaaacaagagaacgaaaccuuaaaauaaaauucagccaccaaguagaccagaaaaugaacaggaaaguugcggacgacacaauuuauggaacgcgucaagcgcaacuaggaaaagacaagaaagaagaaacauacguuauaggaaaaauuaaagacauauacaacuacgaugaauauguaagauucaagaaacgauaugacaaaaacaaagagagcuuccuaauguaucaccaugacccacagacauuugagaaacuagaagaaauucuagcucaauacccugaauauauagaagacgaaaaaggaaagaaaaagaaaguaucuccauucgcucuauaucgagaagaaaacggcccaguaacaaaauacgcaaagaaaaauaacggaccaguaaucaaacaguuaaaauacuaugacagcaaacuuaaccgcaaaauagauauaucacacaaauauagcaccaaaaaccgacaagugguacuccaaagccucaaaccuuauagaacagauguauacagaaaucaagauacaggagaauauacacuggugggaauugaccagaaugaugguaaauuuguaaacggacacuacgguauacccaaaaguagauaugaagaaauaaaagccaacaauaaauuaagcgaacacgacgaauuuguauucucccuauauaaaaacucuaugguaaaaguuauagaugaaaacggcgaaagcauaguaguuagauaccuaucaagaaguaugccaaaccguaaaaacaacgcagagauuaaaccgguggaaaaauaccaauucgaagauggagagguaguaccuguauacgguaaaugcagaaaacaaaugcaaacaguauuugucaaaaagggcuggacguuacuaaaaggaaacacagacauucuaggaaauaccuacuucguagaaaaagaaagugagaacccaaagaaaaugauugaugauaaauga

SEQ ID NO: 5164 - RNA, 3423 nt, Artificial Sequence
  Cas9 variant
augagagaaaacggaagugacgaaagaagaaggaauauggaugagaaaauggacuauaggaucggacuagacauagggauagcaagugucgguugggcuguauuacaaaauaacagugacgaugaaccagugagaaucguagaccugggcguaagaauauuugauaccgcagaaauaccuaaaacaggcgaaucauuagcuggaccacggagagcagccagaacgacuagacguagauuaagacgccguaaacacagacuugaccggauaaaaugguuauucgaaaaccaaggacuaauaaacaucgaugacuuuuuaaaaagauauaacauggcaggcuuaccagauguauaccaauuaagauaugaagccuuagauagaaaauugacagaugaagaacuggcacaaguacuacuacauauagcaaaacacaggggauuucgcaguacgaggaaagcagaaaccgcagcaaaagaaaauggcgcaguacucaaagcaaccgacgaaaaccagaaaagaaugcaagaaaaagguuaccgaacgguuggggaaaugauauaccucgacgaagcauuucgaacagguugcucauggagcgaaaaggguuauauacugacacccagaaacaaagccgaaaauuaucagcacacgaugcuaagagcuauguuagucgaagaaguaaaagaaauuuuuaguagccaaagacgucuaggcaaugaaaaagcuacagaagaacuagaagaaaaauaccucgaaauaaugacaagccaacggucauuugaucuaggaccaggaaugcaaccagauggcaagccuagcccuuaugcaauggaaggauuuucagauagagucggaaaaugcacauuccuuggagaucaaggggaacuuagaggagcaaagggaacuuauacugcagaauauuucguagcacuacagaaaauaaaccacacuaagcuaguaaaucaagacggcgaaacuagaaauuuuacagaagaagaaaggcgggcauugacucuauuacucuuuacucaaaaagaaguaaaauaugcagcaguuagaaagaagcugggauugccggaagauauauuauucuacaaucuuaacuauaagaaagcagcaacaaaagaggagcaacaaaaagaaaaccaaaauacagaaaaagcaaaauuuauagguaugccuuacuaucacgauuauaagaaaugucucgaagaaagaguaaaauauuuaacagagaacgagguacgugauuuauucgacgaaauuggcaugauuuuaacauguuacaaaaaugaugacaguagaacagagaggcuugcgaaauuaggucuaguaccaauagaaauggagggacugcuugcauauacgccuacaaaguuccaacauuuaucaaugaaagccaugcgaaauauaaucccauuuuuggaaaagggaaugacauacgacaaggcuugcgaggaagcuggauaugacuuuaaagcagacuccaaaggaacaaaacagaaauuauuaacaggagaaaacgucaaucaaacaauaaaugaaauaacuaauccuguaguuaaacgcagugugagucaaacaguaaaagugauaaacgcaauaauucgcaccuauggaagcccucaagcaauaaacauugaacuugcccgagaaaugagcaaaacauucgaagaacgaagaaagaucaagggugacauggagaaaagacagaaaaauaaugaagaugucaagaaacaaauucaagaacuaggaaaauuauccccaacaggacaggacauucuaaaauaccguuuguggcaggaacaacagggcauaugcauguacucgggaaaaacgauaccauuagaagaauuauuuaaaccagguuacgauauagaucauauacuaccauacucuauaacauucgacgacucguuuagaaauaaaguucuaguaaccucgcaagaaaacaggcaaaaaggaaaucgaaccccauaugaauauaugggcaaugaugaacaaagauggaaugaauuugaaacgagaguaaaaacaacaauaagggacuauaagaaacaacaaaaacuacuuaagaaacauuucucagaagaagaaaggucagaguucaaagaacgaaauuugacagauacuaaauacauaacaacuguaaucuacaauaugauaagacaaaacuuggaaauggcgccacuaaaucguccagagaaaaagaaacaaguaagagcaguaaauggugcaauuacagcauacuuaagaaaacgcuggggauuaccucagaaaaauagagaaacugacacccaccaugcaauggacgcaguuguaauagcaugcugcacagacgguaugauucagaaaauaagcagguacaccaaaguuagagaacguuguuauucaaaagguacugaauuuguugacgcagaaaccggugaaauuuuuagaccagaagacuauuccagagccgaaugggacgaaauauuugguguucacauaccaaaacccugggaaacauuccgggcagaauuagacguacgaaugggagacgaucccaaaggauuucuagauacacacagcgacguagcccuagagcuagacuacccagaauauauuuacgaaaaccuaagaccuauauuugugagucguaugccaaaucauaaaguaacaggagcagcucaugcagauacaauacgaucacccagacauuuuaaagaugaaggaauaguacuaacaaaaacugcacuaacagaccuaaaauuggacaaagacggagaaaucgacggguacuacaacccacaaagcgaucuauuauuauaugaagcacugaaaaagcaauuauuauuguacgguaaugacgcaaagaaagcauuugcacaagauuuccacaaaccuaaagccgaugguacagaaggaccggugguacgaaaaguuaaaauacaaaagaaacaaacgaugggaguauuugucgauucugguaacggaauugcagagaacgguggcauggucagaauagauguuuuccgagucaauggaaaauauuacuuuguaccuguauacacagcagacguuguuaagaaaguacuaccaaaccgcgcgucaaccgcucauaaaccauauggugaauggaaaguuauggaagacaaagauuucuuauuuagccuauacucaagagauuugauacauauuaaaaguaagaaagauauaccaaucaaaaugguaaacggaggaauggaaggaauaaaagaaaccuaugcuuauuacauaggagcagauaucagugcagcaaacauacaagguauagcacacgacagccgauacaaauuuagagguuuaggaauacaaucacuggauguuuuagaaaaaugucaaauagauguguuaggacaugucuccgucguucgaagugaaaaacgaaugggauuuucauga

SEQ ID NO: 5165 - RNA, 3423 nt, Artificial Sequence
  Cas9 variant
augaacggauuaguacuaggacuagacaucggaauagcaucuguuggaguaggaauacuagagaaaaacaguggaaagauuguacaugccucgagcagaauuuucccugccgcaaccgcagauaacaacguugaacgccgaaagaaucgacaagcgagacgacugaacaggaggaagaaacaccgcggcguccgauuucaagaucuauucgaagacuauggccuacuuacagacuucucuaaaguuuccauuaacuuaaacccuuaccgacuacgaguugacggacuuaaucaacaacuaacuaaugaagaacuauucauugcacuaaagaacauaguuaaacguagaggcauuuccuaucuagacgaugccucagaggacgguggaacaguaucaagugauuauggaaaagccguagaagaaaacagaaaauuauuagccgagaaaaccccaggucagauacaacuagaaagauucgaaaaauacggacaacuacgaggcgauuucacgguaguggaaaauggagaaaaaugucgucugaucaauguauuuagcacaucagcauauaagaaagaagccgaacgcaucuuaagaaaacaacaagauuuuaacaaccaaauaacggacgaauuuaucgaagauuaccuaaaaauacucacuggaaaaagaaaauauuaccaugggcccgguaaugaaaaaucaagaacagacuacggaagauacacaacacauaaagacucaaaaggagaauacguaacauuagacaauauauucggaguacucauagguaaaugcacauuuuacccaaaugaauaucgagcaaguaaagcaucuuacacugcccaggaguucaaccuacuaaaugacuuaaacaacuuaaccgucccuacagaaacaaagaaacuauccgaagaacaaaagaaaaccauaauagaauacgcaaaaucugccaaaacuuuaggugcaagcacacuauuaaaauacauagcaaaaaugauagacaccagcguagaccaaauacgaggauauagaguugacguaaauaacaaacccgaaauacauacauuugaaguguacagaaaaaugcaaucacuagagacuauuucaguaggagaacuaucgcggaauguguuagacgaacucgcccauauacuaacacuaaacaccgaaagagaaggaauagaagaagcaauaaauaccaaacuaaaagacuccuucucucaagaccaaguacuugaacuugugcaauucaggaaaaacaauucgucccucuucucaaaagguuggcacaacuuuagccuaaaacugaugauggaacuaaucccugaacuauacgaaacaagugaagaacaaaugacaauacuaaccaggcuagggaaacaaaaaucaaaagaaacaagcaaaagaacaaaauauauugaugaaaaagaacucaccgaggaaauauacaauccaguagucgccaaauccguucgacaagcgaucaaaauuauaaaugaggcuacaaagaaacauggaauuuuugacaauauagucauagaaauggcaagagaaaacaacgaagaagaugcgaagaaagacuauauaaaacgccaaaaagcaaaccaagacgaaaaauacgcagccauggagaaagcagcuuuccaauauaacggaaagaaagagcuaccagacaacauauuucauggccacaaagaauuagcaacaaaaauucgacucuggcaccaacaaggagagaaauguuuauauacuggaaaaucaauaccaauaucggaucuaauacacaaucaguacaaauacgaaauagaccauauuuuaccacucucauuaaguuucgaugauagccuaagcaacaaaguccuaguacuagcuacagcuaaccaagaaaaagggcagcguacaccauuucaagcacucgacucaauggaugaugcauggucguacagagaauuuaaaagcuauguaaaagagucaaaacuauuaggaaauaaaaagaaagaauaucuacuuacagaagaagauauuagcaaaauagaaguaaaacaaaaauuuauagaaagaaaucucguagauacaagauacucuucacgagucguccucaacgcauuacaagacuucuacaaaaaccauaacuuugacacgacaauaucagucguaagaggccaauucacaucacaacucagaagaaaauggggucuggagaaauccagagaaacuuaucaccaccaugcuguagacgcauuaauaauagcugcgagcucucaauuacgguuauggaagaaacaaaacaacccucugauagcuuauaaagaaggacaauucguagacucacaaaccggagaaaucauaagucucaccgacgaugaauauaaagaacucgucuuuaaagcaccauacgaucauuucguugauacacuauccagcaaaacauuugaagauucaaucuuauucucauaccaaguagacaguaaauucaauagaaaaauuagcgacgcaacaauuuaugcuacaagaaaagcaaaacuagauaaagaaaagaaagaauauacauauacucuaggaaaaauaaaagacauauauucacuaggaacaaaaacuccauccaaaacuggauucuauaaauuccuagaccuuuauaauaaagauaaaucacaauuccuaauguuucagaaagauagaaaaacaugggacgaaguaaucgagaaaauaauggaacaauacagacccuuuaaagaauaugauaaagcuggaaaacucguagacuucaauccuuuugaaaaauauagacaagaaaacggaccaauaagaaaauauaguaagaaaggaaacggcccugaaauaaaaucauuaaaauauuacgacauacuacuagguaaacauaaaaacauaacgccugaaggcucaagaaacacaguugcacuacuaagccuaaaucccuggagaacagauguauacuauaauauggaaaccaagaaauacgaguuccuggguuuaaaauacgccgaucuaccauucgaagaaggaggggcuuacgggauuagcacagaaacauacaacgagcuaagagaaaaagaaggcauagggaaaaauucugaauuuaaauucacucuguauaaaaacgauuuaauacuuauaaaagacacagaaaccaacugccaacaauuuuuccgauuuuggucaagaacaggaaaagacaaccccaaaucauucgaaaaacacaaaauagaacuaaaaccauaugaaaaagcaaaauuugaaaaaggagaggaacuagaaguauuaggcaaaguaccaccaagcucaaaccaauuccaaaagaauaugcagaucgaaaaccuaagcauuuacaaaguuaaaacugacguucuaggaaacaagcacuucauaaagaaagaaggagauaagccuaaacuaaaauuuuga

SEQ ID NO: 5166 - RNA, 3423 nt, Artificial Sequence
  Cas9 variant
augaauggccuaguauuaggguuagauauugguauagcuuccguuggagucggaauccuaaaaaaagauauaggugaaauaauacacacaaauuccaggcuauuuagugcagccaccgcagacaguaacaucgagaggagaggucaucgcggcggaaaaagacucacaagaaggaagaaacacaggagcauacgccuucaugaccuauucgaagacuucggauuguuaaccgacuucucaaaaguaaguauuaaccuuaauccguaccaacuuagaguacaaggucuagacaaccaguuaacaaacgaagaacuauuuauagcucuaaaaaacauugucaaacgaagaggcauaaguuacuuagacgacgcaagcgaagauggagguaccguaucaucagauuacggaaaagcggucgaagaaaauagaaaauuacuggcugaacagaccccuggccaaauccaacuagaucgauuugagaaauacggacaaguacgaggugauuucaacguaguggaaaacggggagaaacgcagacuuauaaacgucuucacaacgagcgcauauucaaaagaagcagaaagaauacuuagaaaacaacaagaauucaauaaaaaaauaacagacgaauucauagaggauuaccuaacaauauuaacaggaaaaagaaaguacuaccaugggccggguaaugaaaagucaagaacagauuauggaagauacacaacaaaaaaagauccggaagguaaauacauaaccuuagauaacauauuuggcauacuuauaggaaaauguacauuuuaucccgacgaauacagagcaaguaaagcaaguuacacagcacaggaauuuaauuuacuuaaugaccuaaacaaucucacaguuccaacagaaaccaaaaaauuaagugaagaacaaaaaaagaccauaauuaaauacgcuaaaacagccaaaacacugggagcaucaacccuacuaaaauauauagcgaaauuaauuggagcaaguguagaccaaauccauggauacagaauugacccuaacaaaaaaccggaaaugcauaccuuugaaacauauagaaaaaugcaaagccuagaaacuauaaguguagaagaacuaccaagaaaaguacuagacgaacuagcucacaucuuaacauuaaacaccgaaagagaaggaauagaagaagcaaucaacgcaacauuaaaagauacguucucacaagaucaaguauuagaauuaguccaauuucggaaaaacaacagcucguuauucuccaaaggauggcacuccuuuagucuaaaacuuaugauggaacuuauaccugaacuauacgaaacaucagaagaacaaaugacaauccuaacgagauuaggaaaacaaaaaucaaaagaaacaucaaaaagaacaaaauacauagaugaaaaagaacuaacagaagaaauuuauaaccccguaguugcgaaauccguucgacaagcaauaaaaauaaucaacgaagcaacgaaaaaauacggcauauucgacaauaucguaauagaaauggccagagaaaacaacgaagaagaugcaaaaaaagaauacauuaaaagacaaaaagcuaaccuagaugaaaaaaacgccgccauggaaaaagcagcauuccaauacaaugguaaaaaggaauuaccagacaacguauuucacggccauaaagaacucgccaccaaaaucagacuauggcaucaacaaggagaaaaauguuuauauacuggaaaaaauauaccuauuuccgaccucauacaaaaccaauacaaauacgaaauagaccacauacuacccuuaaguuuaucuuuugacgauaguuugucaaauaaaguacuagucuuagcuacagcaaaccaagaaaaaggacaacgaacgccauuucaagcauuagauagcauggacgacgcuuggucauauagagaauuuaaaaguuacguaaaagacaguaaacuucucggcaauaaaaaaaaagaauacuuauuaacagaagaagauauaucaaaaauagaaguaaagcagaaauuuauagagagaaaccuaguagauaccagauauagcagucgggugguauuaaaugcguuacaagacuucuacaaagaacaucaauuugauacuacgauaaguguaguacgaggacaauucacuagccaauuacguagaaagugggguuuagaaaaaagcagagaaacauaccaucaccacgcgguagacgcuuugauuaucgcagcaagcucccaauuacgacuauggaaaaaacaaaacaacccuuugaucucauacacugaaggacaauuuguggaccaagucaccggggaaauaauuucauuaagcgacgacgaauauaaagaauugguguucaaagccccauacgaucacuucguagauacgcuuaagaguaaaaaauuugaagacagcauuuuauuuucauaccaaguagauagcaaauacaaccgcaaaauaucagacgcaaccaucuacgcaacucgaaaagcaaaauuagauaaagaaaacaaagaauacacauacaccuuaggcaaaauaaaagacaucuacgcgcuagguacuaagucgccaucgaaaacaggauuuuauaaauuuuuagauuuauacaacaaagauaaaagucaauucuugauguuccaaaaagaucgaaaaacuugggaugaaguaaucgagaaaauaauugaacaauauaggccuuucaaagaauaugaugaaaauggaaaagaaguagacuucaacccauucgagaaauaucgcauagaaaaugguccaaucagaaaauauagcaaaaaaggaaacggaccugaaauaaaaaguuuaaaauacuacgauaauuuacucggcaaauuuguagauaucacgccgagugaaucgaaaaacccaguugcccuacucucucuaaauccauggaggacugacguauauuacaacaccgaaacaucaaaauacgaauuccuaggacuaaaauaugccgaccuauguuuugagaaaggaggcgccuauggaauuucagaaguaaaauauaauaaaauucgagaaaaagaaggaaucgggaaagaaagugaauucaaauucacacuguauaaaaaugaucuuauuuuaaucaaagacacagaaacaaacugccaacaaauauucagauucuggucaagaaccggaaaagacaacccuaaaucguucgaaaaacauaaaauugaacucaaaccauacgaaaaagcaagauucgaaaagggagaggaauuagaaguuuuaggcaagguaccccccucgucuaaucaacuccaaaaaaauaugcagauagaaaaucucuccauuuauaaaguaaaaacagacguacuuggaaacaagcacuucauaaaaaaagaaggugaagaacccaaacuaaaauucuga

SEQ ID NO: 5167 - RNA, 3423 nt, Artificial Sequence
  Cas9 variant
auggaagaaaauuuucaguauagaauuggacuugauauagggauuaccuccguaggcugggccguuuuacaaaacaacucacaagacgaaccaguaagaauaacagauuuaggcguaagaauauucgauguagcagaaaaucccaaaaauggcgaugcgcuagcagcuccacgaagagaugcccgaacuacgagaaggcgacuacgcagaagaagacaucgauuagaaagaauaaaauuccuuuuacaggagaauggcuugauugaaauggauucguucauggaaagguauuauaaagggaaucuuccagacguauaccaacuaagauaugaaggauuggacagaaaauugaaagacgaggaguuagcacaagugcuaauacacauugcuaaacauagaggauuucgaaguacaagaaaagcagaaacaaaaggaaaagaagggggugcaguacuaaaagcuaccacagagaaucagaaaauaaugcaagaaaaaggcuacaggacaguuggagaaauguuauaccuagaugaagcauuccauacugaauguuuauggaaugaaaaaggauacguuuuaacuccaagaaauaggccagacgacuauaaacauacaauucuacgaagcauguuaguugaagaaguucaugcaauauucgcugcacaacgagcacuaggaaaugaaaaagcuacagaagaauuagaaaacgcuuacguagaaaucaugacaagccaaagaaguuucgauauggguccaggauuacaaccagaugguaagccaaguccauaugcaauggaaggcuuuggagacaggguagggaaauguacauuugaaaaagacgaauauagagcaccaaaagcaaccuauacugcagaacuuuuuguugcacuacagaaaauaaaucacacaaaacuaauagaugaauuuggaacuggaagguucuuuaccgaagaagagagaaaaacuauaauagauuuacucuuaucaggcaaagaacucaaguacggaacaauaagaaagaaauuaaauauagauccaagccuaaaauuuaacucauuaaauuacucagcaaagaaagaaggcgagaccgaagaagaaagaguaagggauacugaaaaagcgaaauuugcuuccauguucuggacauaugaauacaguaaaugccuuaaagacagaaaugaagagaugacaguaggccaaaaagcagaccuccuugaucguauaggagaaauacuaacagcauacaaaaaugaugauagccgaucuagucgacuagaagaucuaggauuaagucgugaggaaauagacggcuuauuagaacuaucaccagccaaauaucaacgaguaucacuaaaagcaaugcgaaaaaugcaaccuuaucuggaagauggccuaaucuacgauaaagcaugugaagcagcaggauaugacuuucgugcauugaaugauggcaacaagaaacauuuacuaaaaggcgaggaaauuaaugcgaucguaaacgauauaacaaacccaguaguaaaaaggucaguuagucaaacaauuaaaguaauaaacgcuaucauucaaaaauauggaaguccacaagcugucaauauagaacuagcaagagaaauguccaaaaauuuucaagaucgaacaaauuuagaaaaagaaaugaagaaacgacaacaagaaaacgaaagagcuaaacaacaaauaauagagcuagguaaacaaaauccaaccggacaagacauauuaaaauacagacuguggaaugaccaaggaggcuacugccuuuauucaggaaagaaaauuccacuugaggaacuuuuuggaggcggauaugacauagaucacauacuccccuauucaauuacauuugaugauaguuauagaaauaaaguacuuguaacagcccaagaaaaucgacaaaaagguaauagaacaccuuaugaauauuuuggagcagaugaaaaacauugggaagauuacgaagcaagaguuagauuauuaguaagagacuauaagaaacaacaaaaauugcuaaagaaaaauuuuaccgaagaggaaaggaaagaguucaaagaaagaaauuuaaacgacacuaaauauauaacaagaguaguguauaauaugauccgccaaaaucuagaauuagaaccuuuuaaccaucccgagaaaaagaaacaaguaugggcaguaaacggagcagucacaucauauuuaagaaaaagauggggacuuaugcaaaaagauagaaguacggaucgccaucaugcaauggacgcugucguaauagcauguuguaccgauggaaugauacauaaaaucucaagauauaugcaaggaagagaacuugcauacagccggaacuucaaauuuccggaugaagaaacaggugaaauccuaaauagggacaauuuuacaagagaacaaugggacgaaaaauuuggaguaaaaguaccguuaccauggaacucauuuagagacgaauuagauauuagacuucucaaugaggauccgaaaaacuuucuucuaacacaugcagacgugcaaagagaauuagauuacccaggauggauguauggagaagaagaaucacccaucgaagaaggcagauacauaaauuacauacgcccauuauuuguaagcagaaugccgaaccauaaaguaacaggaagcgcacacgacgccacaaucaggucggcuagagacuacgagacucgaggcguaguaauaaccaaaguaccccuaacggaucuaaaauugaauaaagauaacgaaauugaagguuacuaugauaaagacagugaucgacuacuauaccaagcauuaguucgacaauuacuauuacauggaaacgacggaaagaaagcauucgcugaagauuuccauaaaccaaaagcugacgguacagaagguccaguggugaggaaagucaaaauagaaaagaaacaaacuagcggaguaauggucagaggcgggacaggaauugcagcaaauggcgaaaugguaagaauugauguauuuagggaaaauggcaaauauuacuuugugccuguauauacugcagaugucguuagaaaaguucugccuaauagagcugcaaugaauggaaaaauagcgagugauuggaaaacaauggaagacaacaauuuuguuuuuagucuguauaguagagacuugauucauguuaaaaggaagaaagcgauuccuacaauucuaaguucuggugcaacuuucgaacaagaagaauuuuaugcguauuuuacaggugcagacauaagcacagugucuauagcgggcauaucaaaugacaacaguuuuaaauucagaggucuugggauucagggauuagaaauauuugagaaaugucaaguagacauauuaggcaauauauccgucguuagacaugagaauagacaaggauuucauuga

SEQ ID NO: 5168 - RNA, 3426 nt, Artificial Sequence
  Cas9 variant
auguacucaauuggauuagauauaggaauugcaaguguuggcuacuccguaauagagacaaacucagggagaauaguagaauuaggcgcaagaauuuuugaagccagaaauagcgacaauaacaaagauagacgagauuuccgaggagggagaagacucauuagacgucgaaagacccgauuagacgacgcuaaaagauacuuagaugaccaaggauuuaaaaacgauaaaucguuaauaaauguaugcccauauagucuaagaguuaaaggauuaaccgaagaacuuucaaaaucagaaauccgaaaaguaauucuacacauauuaaaaaaacguggagucucauauuuaucaucugaagacuuagacacaaguaguguggacaacaaagacucauucaaacaagcgguaacaaaaaaucuuaggcaacucgaugauaaaacaccaggacaaauacaauaugaaagauuacaggaaucaggcagaguccgaacggggauaaaccagaacggacaauaccaauuaaacguauuugauguugcaucauaugcaaaagaacuaaaacuaaucuuagaaacacaacaacaauaccaucaagaaauagacgaccacuuucuagacuucuuuacuaaagacggguaucgggaagaugcaggauugauuuacagaaaaagaccauauuacgacggaccaggaaacgccgcccaaaacucaucguauggacguugggcaaacuaccaagucgauggaaaaccugccgaaaacauauucgaucaacuaauugguaaggauuucacaggaaaaauaagagcaucuaaccuagguccaagcgcgcagaaauuuaaccucuuaaaugaccuaaauaauuuacgaauuacaacaagagaagaggaaaaacuaacuuuugaggaaaaacaagaaauauuagaaguacuagaaaacgauagacccaaaaccuucggcccacgaaacauugcaaaaauguugaaagucgauauggacgacauaaaaggauggagacuuaacuccucagauaaaccugaaauccauacaaugaaggaauacaaugauaugagacuaguacuagaagcaggaggguuugauauuaaagccauagauuuggaccacauagaagagauagcgucccuuauaacacuaaauacggaaagagaagcauuugaacuaucacuuucaaacgaaauagacaacaaucuaaaacaauuucuuguagagaauuuuaaugcuuuaaggaaauguaaaccuaacaacaguuggcauucauucucgaaagaaaaccuacaaagacuaaucacugagcucgaacacacuuccgaugaacaaaacacaauacuagaaagacugggacuaaaauucgaucucagaucaaaauacagugauagggauacacuuccuauccaugaaguacucgaagagauauauaaucccacaguaucuaaauccguuagacaaacauuuagaguauuaaaugcacuuguaaaaaaauacggaaaagaaaacauagauuacguuaccaucgaaaugccaagagauaaaaacgaagaugaucaaaaaaaaacaaucagagaaauucaaaaagugaacaaaaauagaaaagacaaaagcaaagaauauuuccuaaagaaaucaggauggagcgaagaaaaauucgaagaaaaacucagaacaagccgacguuucgcuuccaaacucuacuacuucuaugagcaagauggccuaugcgcuuacaccggccaacaaauacaaccagaagacuuauuaacugaacguguagaaguggaucacaucauuccauuaaguguaagccuagaugauagcauaaacaacaaaguucuuguaaccuccgaggcgaaucaaaaaaaaggacaaagaaguccuuaugaugcauucaugagcggcgacuucaguaaauacagaacauacgaugaauacaaggcguggguacuaucaaacaaauacaaaaaauauaaaaaggcauuauuauuagaagaaagaaacauauuugauccagagcuagcaaaaaaauuuagacagcgaaaccuuaacgacacacgauaugcuucaagaauaguacucaaugcaguacaaucuuuuuuuuacaaaacagauacaaagaccagagucguaaacggagcauucacucauacacucagaaaaaaauggaaccuagcagauaaagacagagaaacacaccaccaucaugcaauagacgcaacuuuaguugcaguaacaccguuuguaaaggcagaaagauacgaauacuauaaagauagugaaggcaaagccaguaugguggauacagucacuggaacaauaaucccauacagugaauacaaaaaaaaaaauuuauacgauagaucuaauuauuuacucauguucgguaaugaauccacaauaaaccaagaaaaagaagacaaaucagcagaguuuaucagaaaccucauuccagcaaaaauuuacccagaaauaaaauuuucccaccaagucgacagaaaaucaaauaggcgacuaucagaugccacaauauauaguacacguucuuacacaguagaaaaaggucgaggaaaaaauaaaagagaaguaauagaaagagauauaauaggcaaaauuaaagacauuuauacugcagauggauaugcugaauauguaaaauauaaagacucacuucucguaaaggaaaucgaugaaaaaacauucgagaaauuagaagcuauaauugaagaauuuucagauaccguagaaguaacagaucaacaaggcaaaguaaaaaaaguaucaaaaucaccauuucuacaguauugcgaaaaauacgacguaccaggugucaccaaauauucaaaaaaaaacaauggaccaguaauaagaucucuaaaauaccgauauaccaagcuacgcucccauauagauaucucaccaaaaaacagcaagaacacaguggcgcuauuaacacuugcacccuggagaaccgacgucuauuacagucaagaaacugcauccuaucacuuauuaggauuaaaauauauugaucuaucauuuagagacggcggcuacggaguaucuagaaagagauaugaagaaauaaaaaagaacgaaaggaucccagaagacggagaauuuaaauuuagcuuguacaagaaggacuacauugaaaucgaauucgacaaaaaaauauuaccaggccuuuaucaaucaagagauguuagugccagaaacaaauucagcaugaaaccaaucgauaaagcccaauggacaagcaaggaagauguacucauguucggaaacgucaaagcuucaggaguauucgaaaaaacauuaaaaaaaaacuacgucuuacgaaaguaccacguugauguacuagguaacaaguucgaaguaaaggaugagauacuuaaagauauacucgaauga

SEQ ID NO: 5169 - RNA, 3429 nt, Artificial Sequence
  Cas9 variant
auguauagcguaggucucgacaucgguaucgcgucauguggauacucaauaaucaacgacguaaacggaaauaucguugaacuaggaacucuauuauuuaaaucacgaaacucagacaacaaugaagaaagaagaaccaacagaggaucccggagacucauaaaccgucgaagaaccagacucgacgauggaaagaaauuacuagcagaaaaaggauucaaacaagacucuaaacuaaaacacguauguccauacgaguuaagaguaaaagguuuacacgagaaacucacccaaggagaaaucuacaaaguaguacuccauauccuaaagaaaagagguaucucuuaccuagacgaaucggaugaaaacucuagcgggauagauggugcaaguuacaaagaucaagucaaucuaaaccuaaacuuacaaaaagaauuaacaccaggacaaauucaacucaaacgucuaaaagaaaacggcagaauaaaaagcggaguaacauuugaaaaugguuaccaacucaaugucuucagugucuccgcguacgcaaacgagcugaauaaaauacuuacaaaacaaucagaauauuacucagaaauugaccaaauuuggauagaccgauuuacgaaaaacggguaccguaaagaagcuggacucguuuaccgcaaaaggccauauuacgacggaccaggcaacgagaaaaacaacagcauuuacggaagaugggccaacuuuaaagaagauggacacccgaaagaaaacauauuugaucagcucauaggacuugauucaguagauuccacacaaguaagagcaucugcaucaacauuaacagcccaaaaauauaacuuacuaaacgaccuaaacaaccuaacaauuauagaagacgaccgaaaauuuacaacugacgaaaaaguaucgauaaucaacuacuuaaugacccaggauaucacacgauucggucccaaagaacuagcaaaauuuuaccagcuagaaguugaucaaauucgugguuggagaauagacaacaaaggaaacccggaaauccauucauuaaaaguauacagagauuggaagaaaauauucaacacaaguucaauagaccuaacaaguauacaaacuugggugguagacgaauuagcaaacguuauaacauuaaacacggaaaucccauccacauuagccacacuaaaaaucaaaauaccagacauagaucaacaaauuuuaaauuuuguagaaaacaacuucuacgaacuaaagaagaaaacaagcaaaaacucauggcauucguucucacuuaaaacauuaaauauacuaauaccagaacucuuaaacacaagcgaagaacagaauacgauauuagaaagacuuaacuuaaaauucgauuugaaaaauaaauaugcagaaaagaaccaaauuccuguuaaagaauuacuagaacaaauuuauaauccaaccguuacaaaauccguacaccaaucuauaaaacuauucaaugaaauaauagaaaaauacgguaaaaauaauauuucauauguaaccaucgaaaugccaagagacaaaaaugaccaagaucaaaaagauacaauuaaacgaauuaacaaacucaacucagaaagaaagaaugacuccgaaaaauauuucuuagaaagaucaggaugggacacaauaagauucgaaucagcccuaaagaaaccuagauucgcugaaaaauuacucuucuacuaugaacaaaaaggaaaaugugcauacaguggacaggacauauuagcagaaucacuacuaaacgaaucaugugaagucgaccacaucauaccacuaucaauaucguuugacgacucgauccacaacaaaguucuuguuacagcaucaucaaaucaagaaaaaggacaaagaaccccauacauggccuuuauagauggagcaaaacuaggucaaagcugggaugauuucguugccuggguaaacucuugcggauuucaucgaaagaaaguacaaaacuuacucuacgaagaaaauaucuuuaacccagacguacaaagaggauucguuuccagaaacuuaaacgauacgagguaugcaagcagaauaguacugaaugccauccaaucuuucuucuauaaacaaaaagaucuaacaaaaguuaaaguaguaaacggaucauucacacauacacuacgaaagaaauggggaucaucacuggauaaaaauagagacacuuaccaccaucacgcaguugacgcgacccugugugccguaacgcccuuuauuaacaucguaaaauacgaguucuucgaagaagacgguauaaaauacaugguagaccuaacaacaggggaaaaaguugcguacucagauuacaagaaaaugaaauuuuaugacaaaagagcauacguaccaauaugggauggauuuaucaaacaacucacaccggcuaaccuauaccccaaaauaaaauuuucacaccaaguugacucgaaauggaauagaaaaauaagugaugccacgauauauaguacucgcaaaauaguggaaacaaaaauaaacaagaaaggaguagcaaaagaaacuguaaaagacauaguaaucgacaaaauaaaagacauauauacaccagaaggauggagaaaauucaaagaaaaacaagauaaacuauuaaugaaaaauuucgacgagaaaacauacaacaaauuaaucaaaauugccaaagaauaccccgaaaagaaagaaguacaaacauccaaugguaaagucagcuuaguagaaguaucaccauuuaaaauguauugcgaagaacaaaauguaccagcuauucgaaaauacucaaagaaaggaaauggcccauacauacggucgcucaaauuuuaugauaaagaauugggcaaacauauaaacauaaccaaagauagcuacggaaacgauauugaacguacaauacgcaacaagaaaaucauacucaaaaaccaaaauuccuggcgaacagauguguacuauaauucaguaaauaauugcuaugaacuguuaggcauaaaauacugucaccucaaauuuuaucguggcaaauauggaauacccaaaagcauuuacgacgaacuaaagaaagaagaugaaauaucaagcgaaucaguuuuuaaauuuuccuuauacagacacgauagaguaagauucgaaaaagacggagaauauauagaggcuuuauucggaagcaaaaacgaaucaaacaaaaacuaccuugaacuuucaccuauagacaaaaacaaauggcuaucaaaagaaaauguaaaauucuucggagaaguagcugccucuggccgcuuuaucaaaggcuuaaagcccgguauaaaaguaauaaagcaaucaacagacuacaugggacauguauaugcgauacaccaagaaaaauugaaauucguacuaucagacgcuuga

SEQ ID NO: 5170 - RNA, 3435 nt, Artificial Sequence
  Cas9 variant
augacaucuaaacaagaaaaacauggagcacuaacauuuggacuugauauagguauagcuucaguaggaugggcaguuuuaggggaaucuagaauaguagaucuuggaguaagguguuuugacaaagcugaaacugcaaaagaaggugaaucguuaaacuugacgcggagaauggcaagauuacucagaaggagacuacgaagacgagcuuggagauuaacgaaauuagcgagguuauuaaaacgagaaggucuaauugcggaugcaaacuuauuuaaacacaaaauagagaaaaacacccccguccccaaaucaucuuggcagcuacguguagauggauuggauagacaacuaaacgcggaagaaugggcaagaguuaucuaccacuuauguaaacauagaggauuucauuggauaucuagagcagaagaaaaagcagcugaaggugauucuaagggugaaggaggaaaaguaaaacaaggauuagcagggacaaagaaauuaaugcaagaaaaaucauauagaacagcagcugaaaugguuuuagcugaauuuccagaugcacagcgcaauaaacaaggagauuacaguaaagcauuaucgcgaauacuacucggcgacgaauuaaaggcuuuauucgaacaucaaagaaaacuaggaaauccaguagcaaccgaaaaauuggaagcagcaauauuagguaacggagauaaaaagugugggcuauuuugggcucaaaacccagcuuuagcggggaauaaauuauuagaaaugcuugguagguguacauuugaaaagacagggggcgaugauggcaaaggggaauaccgagcaccgaaagcaucuuuuucggcagaaagacauguuuggcuaacacacuuaaacaauuuaagaaucguaguagacggaacaaccagaccacuaaaugaagccgaaagacguguggcuuugccgaugccuuaucaacaagcaggcgaucuuucguacaaacaauugggaggcgcauuaaucaaggaaggauucuugcagaaagauggcuuuaaauuugcaggucuaccauacccaacuaagcaagcaagugaagaaaaagcaaaagauccagaaacaaguguuuuauguaaacuacccgcuuggcauacauugcgcaaaacuuuagaaaagcauggauuagaaucagaauggcagaaauuaucgacagaugcgcuagauggaaaaccucaauuacuagacaauauagcauggguacuuucuguuuacaaagacgaugacgaaguaaaaacugaauugggaaaacuaaaucuacccaauacagaaaagaugauugaugcuuuacuagauauaagguuugauaaauuuucaaauuuaagccuuaaagcucuuucaaaaaucguuccauuuauggaacagggacaacgauaugaugaggcaguagcaaauauccccgaauacgggcaucauucacaacuacacaaaguaggugcaggcgaacauaaauauuugccaccauuuuauaaagaaagagauaaaacaggacgaaugguauuuaacgaugacauggacauaccuaggaauccaguaguacuacgugcccuaaaucaagcacgcaaagucguaaaugcauuaauaaaagaauauggcagcccacacgaaguccauauagaaauggcaagggaucuuucaaggccauuagaugaaaggagagauauagaaaaacuucaaaaagaauuuggugagagaaacaagaaagacaaagaacuauucgcacaagauuuuaauauagucgguacaguaaaaggaaaacaauucgaaaaauaucaauuguauagagaacaacaggggaaaugcauauauccuucgauggacgaaaaacaaggaauaugcuguuacucacuaaaaccauuagaucuacaucggguauuguacgaagaaggauacgcagaaaucgaucacgcauuaccauauucaagaucauuugacgauagcaaaaauaacaggguacuugugcuggcaaaagaaaauagggauaaaggcaauagaacacccuuugaauaucuaggcgauaaagauaacucagagccauggagacaguuuguagcauuugucgaagguaauaaagcguauagacuugcaaaacgaucaagacuucuaagaaaagacuuuggagacaaagaagcuaaagaguuuagagaaagaaaccuaaacgauacgagguauauuuguaaauucuucaaaaauuauguagagcaauacuuacaauuacacgaagauucggaagcaaagagauguguuguauuaucaggacagaugaccucauuccugagagcgcguuggggccuagugaaaguaagaggagacagcgaccgacaccacgcguuagaugcagcuguagucgccgcaugcagucacggaaugguaaaacgucugagugauuacagucgaagaaaagagcuggagcaaguaagggaaggcuuuguagauguagauacaggagaaauaguaaauccagcgauguuccaacaaguucaagaacauuucccaaauccguggccacauuucagagacgagguaaaacuaagauuaagcauugacgacccaacucuauuaaggucagaaauggaaaaauuugggacauacacgccagaaagccuagaggcuuuaaggcccuuauuuguuagucgagcaccgcaacgaagaaacucaggugcagcccacaaagauaccauauaugcacaaccaaaaaggcucguagcacaaggagguguaacacaaaaaguggcacuaaguucccuuaccuuaaaagaccuggauaaauuaauugauccccauagaaacgaaaggcuguaugcugcgauacgagccagauuagaacaacacgguggaaaaggugacaaagccuucccugccucaaauccauuaagaaaaccagacucggaaggaaauccaacaggucccauaguucgaggcguuacgauggugauugauaaacuuaguggaauaccuaucagaggaggaauagcuaaaaacgauagcauggugcgaguagauguuuucacaaaggcgaacaaauuucacuuaguacccguauacguacaucacucuguguugggacuaccaaaccaagcuauuguagggggaaaagaagaaucagaauggacgcaaauagacgacaguuuugacuggcauuucagcaucuauccuaacgauuuaauacggguuaccuuaaagcaggaaggaagguucggcuauuacgcaggaugugacagaaguacugcagcuauacaucugugggcacaugauagaaaccaacaagucggcaaagauggguuaauaagaaguauuggaguuaaaacggcacucucaauagaaaaauuuaauguagauguauuaggaaaccgguacccagcaccuccggagaaaaggcgagauuuagcguga

SEQ ID NO: 5171 - RNA, 3435 nt, Artificial Sequence
  Cas9 variant
augaccuccaaacaagaaaacuugggggcucugacauucggacuagacauagggauugccucaguaggcugggcgguccugggcgaaaaucgaauuauagaccuagggguuagauguuuugauaaagccgaaacagcaaaagaaggugaaagucuaaaccugacaagaagaauggcaagauuacugagacgaagauuaagaagaagggcauggagacucacaaaacuagcacgucuucuaaaaagagaagguuuaauagcggacgcuaaucuauuuaaacacaaaauagagaaaaauacgcccguaccaaaaaguaguuggcaacuacgaguagauggcuuagaucgacaacuuaacgcagaggaaugggccagaguaauauaucaucuauguaaacaccgaggauuucauuggauaucucgagcugaagaaaaagccgcagaaggagauaguaagggagaaggaggaaaaguuaaacaaggauuagcuggcacaaagaaauuaaugcaggaaaaauccuauagaacagcggcugaaaugguucuagcagaguucccagacgcacaaagaaauaaacaaggagauuacagcaaagcauuaucuagaauacugcuaggugaugaacuuaaagcucuuuuugaacaucaaagaaagcuaggaaacccaguagcuacugaaaaauuggaagcugcaauacuaggaaauggcgauaagaaauguggauuauuuugggcgcaaaauccggcacuagcaggaaauaaacuauuagaaauguugggucgaugcacguuugagaaaacugguggagaugaugguaaaggcgaauaucgagcuccaaaagcaucauuuagugccgaaaggcaugucuggcuaacacauuugaauaacuuaagaauaguagucgacgggacuacaagaccucuaaacgaagcagaaagaaggguagcauuaccaaugccauaucaacaggcuggcgaucuaucauauaaacaacuuggaggagcauugauaaaagagggauuucuacaaaaagauggauucaaauucgcaggauuaccauauccaacuaaacaagccucagaggaaaaagcaaaggauccagaaacaaguguucuguguaaacuaccagcauggcauacacuuagaaaaacacuagagaaacacggucuggaaagcgaauggcaaaaacuaucaacagaugcacuagaugguaagccacaacuauuagacaauauagcauggguguugagugucuacaaagaugaugaugaaguaaagacagaacuuggaaaauuaaaucuccccaauaccgagaaaaugauagacgcauuauuagauauucgcuuugauaaauuuaguaaccuaaguuuaaaagcauuaucuaaaauaguuccauuuauggaacaaggucaaagguaugacgaagcgguagcaaacaucccagaauacggucaccauagucaacuacauaaaguuggagcgggagaacacaaauaccucccaccauuuuauaaagaacgggacaaaacagguagaaugguauucaaugaugacauggacauuccacggaauccugucguauuaagagcacuaaaucaagcaagaaaaguaguaaaugcacuuauuaaagaguaugguaguccucaugaaguacacauagaaauggcacgcgacuuaucaagaccccuagaugaacgucgagauaucgaaaaacuucaaaaagaauuuggagaaaggaauaaaaaggacaaagaauuauuugcgcaagacuuuaacauaguuggaacagucaaaggaaaacaauuugaaaaauaucagcuuuaucgcgaacaacaaggaaaguguauuuauccaaguauggaugaaaaacagggaauauguugcuacagccugaaaccauuggaccuucauagagucuuauaugaggagggauacgccgagauagaucaugcguuacccuacaguagaaguuuugaugauuccaaaaacaacagaguauuggucuuggcaaaagaaaacagagauaaagggaaucgaacacccuuugaauaccuuggagauaaggauaacucagaaccauggcggcaauuuguugcauuuguagaagguaacaaagccuaucgacuugccaaaagguccagauuacuacgaaaggacuuuggagauaaagaagcaaaagaguucagagaacgaaaccuaaaugauacccguuacauaugcaaauucuuuaaaaacuauguagaacaauauuuacaauuacaugaagacagugaagcgaaaagauguguuguucuaaguggacaaaugacaucuuuucuuagagcucgauggggccuaguaaaaguacggggagauagugacaggcaccacgcauuagacgcugcaguuguagcagcuugcucacacggaaugguaaaacgauugucagacuauucuagaagaaaagaacuagaacaagucagagaaggauuuguagaugucgacaccggagaaauagucaauccagcuauguuucaacaagugcaagaacacuuuccaaacccguggccacacuuuagggacgaaguaaaacuacggcuaaguauagaugacccaacacuacuaagaucagaaauggaaaaauucggaacauacacaccggaaaguuuagaagcccuaagaccacuuuuuguaucucgagcaccacaaagaagaaacucaggcgcugcccacaaagacacuauuuaugcucaaccaaaaagacuuguagcacaaggagggguaacacaaaaaguggcuuuaucuuccuugacacuaaaagaucuugauaaauuaauagacccacauagaaaugaaagauuauacgccgcaauuagagcacgacucgaacaacacggagguaaaggagauaaagcauucccagcgucgaauccauuaagaaaaccagacagcgaaggaaauccuaccggacccauaguaagaggaguuacaauggugauagacaaauuaaguggaauaccgauuagaggagggauugcuaaaaaugacaguaugguaagaguagacguauucaccaaagccaauaaauuucaccuuguacccguguacguacaucauucaguauugggucuaccuaaucaagcuauaguaggaggaaaagaagaaucagaauggacacagaucgacgacaguuucgauuggcacuuuaguauauacccaaacgauuuaauccgaguaacacuuaaacaagaaggccguuuuggguauuaugcaggaugugauagaucaacagccgcaauccaccuaugggcacaugauagaaaucaacaaguaggaaaagauggucuaauaagaucaauagguguuaaaaccgcacugagcauagaaaaauucaacguagauguguuaggaaauagauauccagcgccacccgagaaaagaagagacuuagccuga

SEQ ID NO: 5172 - RNA, 3438 nt, Artificial Sequence
  Cas9 variant
augaaaacuauauugggucucgaccuaggaacaaauucaauagguugggcauuagucaaagaaacagaaaacagcaaugaaaaaucagaaaucauaaaacuugguguaaggguaaaucccuuaacagucgacgagaaaacuaauuucgaagcaggucgcccguuaucuacaaaugcagacagaacggccaaacgcucagcucgacgcaaccuucaacgauauaaacucagacgcaaaaauuuaauagaucuccuaauaaaacaucgauuaauagauaaagauaccccacuuacagaaauuggcaaaaacacgacacaccaaacucuagaauuacgugcgaaagccgcccgagaacgaauagaauuggaagaccuagccaggguuuuccuagcaauuaacaagaaaaggggauaccggagcucaagaaaaguaaacaacgaagaagaaggacaaguaguagacggaauggccguagccaagaaauuauacgacgaaaaucuaacuccaggccaauacgccuacgaauuacuuucaaaagggaagaaauacguacccgauuuuuaccgaagugaccuacaagcugaauuugacucaauaugggaauaccaaaaacaauuuuaugcagacauucuugacgaugaacuuuauaaugcccuaaaagggcaaggacaacaaaauagccguaaacgcuuccuagcaauaaaagguguauauacagcggaaaacaaaggaaaacgcgaugaagucaaacuucaacacuacaaauggagaucagaagcaauaacacaaaaacuaagcauagaagaaguagcuuacgucuuaguagaaauaaacaacgaccuaaacaaaaguagcgguuacuugggagcaauuuccgauagaucuaaagaauuguacuuuaauaaagaaacaguuggagaaaaccuauggaaacaaauccagaaaaacccacacacaagccuaaagaaucaaguauuuuacaggcaagauuacuuagacgaauuugaacaaauaugggaaacacaagcacaauuucauccccaacuaacguuagcucuaaaagaacaaauccgagauguaguaauauucuaccaacggaaauuaaaaagccaaaaaggacuguugagcuuuugccaauucgaaagcugggaaauugaaagaaaagaugaaaauggaaacgucauacuaaauaaaacaacacaauuaccaaaaagacaaacgguuggacgacgagucgcacccaaaucaucuccucucuuucaagaauuuaaaauauggcaaaacauaaauaaccuggagauagcuaaaauaagugacggaaacucuaaaaacaagaaagaaacagaagcccuaucagaugacgaaagaaaacuacuauucgaagaacucaacuuacgaggcaaccuaagccaaaaagaaguccuucaaauauuaggucuaaaagacaaagaauauaaaacaaacuuccccgaaggacucgaaggaaauagaacaaacgcagcauuguucaacaucuaucaacaaauagcagaaaaugaaggauacggagauuggacgaaaaagucagcucaagagauuaaggaagaacuaaaggcuguauucccucaaauaggaauacaagccgacauacuagacuucaaugcagaacuggacggaaaagaguucgagaaccaagcgucauaucaacuauggcaccucuuauacucagcagaagaggaugacaaaauaaacgaagaagaucagauaauauacggcaacucagccguaucacucaaaaagaaacuaugugaaaaauucggauuuacacccgaauacgcgaaauggaucgcaaauguaucccuacaagacgauuacggaaaccuaucaacaaaagcaaugcgaaaaaucauccccuacuuaauagacggaaacgauuacucugaagccugugcacucgcaggcuauaaucacucgaacucgcucacuaaagaagaaaaugacaacagggaaagacuaaauaaacuagaacuacuacccaaaaacagucuucgaaauccaguaguagagaaaauauuaaaucaaaugguaaacgugguuaaucaagucaucgaaaccuauggaaaaccagaugaaguuagaauagaauuagcuagagaauuaaagaaauccgcugaagaaagagccgaaaugacuaaagguauaaaugaagcaacacgccgaaaugaagacauaaagaaacucaucaccaaaaacuucggcaucccaaaccccaccaaaaacgacguuguaagauaucgacuuugggaagaguuagcgccccuagccuauaaagauguuuuuacaggccgucaaaucaagaaagaggaccuuuucucauccaaaauugacauagaacauauaauaccaaaagcacuacuauucgaugacuccuuuucaaauaaaacauuagccuucagagaaaccaaccuaaagaaagcagaccggacagccuacggauuuauagaaagcgauuauaacgcaacauuagacgacuacauacaaagaguugaaacauuauacaauaaugcuaaaggaacaauaucaaaagggaaacgaaacaaacuucuaauggcgcagaaaaaccucccagacggauuuauagaaagagauuuaagaaauagucaauacaucgcaaagaaagcaaaaucuaugauagaaaaaguauuuaaugacguaaacguaaccaguggaaguauaacagaucgguuaagagaagacugggaccugauaaaugucaugaaagaacuuaacuucccaaaauacaaagcauuaggucuaacggaaauagaggaacguuacgauauaggacaagagaaaaccaagaaaguagaagucauuacagacuggacaaaacgcaacgaucacaggcaccacgcuauggaugcauuaacagucgcuuucacaacaaaaagccauguacaauaucuaaauaacuuaaauacuauucauucuuuaaaaggcgaugaaguagauuuagaacucucaaaacuauacggccuuaaaaauacuaucaccgaaguaguaaauaagaaacgaaaauuuauuccucccaugcccaauuuuagagaagaggcgaagaaacacauugaaaccauauuaguauccaucaaaaauaaaaacaaaguauauaccaaaaacauaaauaaaacuaagaaagaaagcggauaucacacaaaagaacaauuaacacccagaggacaauuacacaaagaaacaguuuacggaaaauccaaaagaccaaugaacaaaccuacaaaaauaaacaaaaauuucucucuagaacaagcccaacuuauaauaaauguucaagaaaaagagcuaguucugcgacacuuagcccaauucgauaauaauccagcagucgccuuugacaccaaaacucugaagaaaugucacuaccuaaaaaugguaaaucuuuga

SEQ ID NO: 5173 - RNA, 3441 nt, Artificial Sequence
  Cas9 variant
augucaggaaauacacaugguccucuuacguuuggauucgauauugggauugcaucaguaggauggugcguccuaggggaaaaccggauaguaaauuugggagucagguguuucgauaaagcggaaaccgcgaaagaaggcgaaucucuaaaucuugcgagacgaacagcaagauugaugagaaggcgacuuagaaggagagcuuggagauuaaccaaauuagcacgacuacugaaaagggaaggauuaauagcagaagcaucaaggauacacaucccaucgccuguuagcccauggagacuaaggguagaaggcauagacaggcgucuaacugacgaugaaugggcacguguaauuuaccauuuauguaaacaucgagguuuucauuggauaagucgggcggaggaaagaaaagcagaaagcgaugcuaaagaaggaggaaggguaaagaaaggauuaucagauacucaaagaagaaugacagaaaaagguuauaggagugcugcugaaaugguacuugcggaauuuccugaugcucaacgaaauaaacaaggagacuauggaaaagcauuaagucgaauccuuuuaucagaugaauuagcuuugcuuuuccgaaggcaaagagaauuaggaaacccaaaugcugguaacgaacuugaagccaccauuuuaggaaaugggaacaggaaaaguggauuauuuugggaacaaaaaccaccucuagcuggugcagaucuguuaaaaaugcuaggcagauguacauucgaaaagaaugaauaccgagcaccaaaggcuucauuuacagcggaacgacacguauggcuuacgagauuaaacaacuuaagaguuguuguggauggaacaacuagaucccucgacgaugcagaacauagauuaguucuaccauuaccuuacaaacaagccggcgauuuuacauacaaacaauuaagaacugcauuaacgaaagcuggauuauuacccgaaggauucaaauucgcaggauuaaguuacccaacaggacgucaauuagaugauccgaaagccaaagacccagaaagugaaaaauuagucaggcuaccagcauggcaggaacuuagaaaaacacucaaagauaaaaaucuagaaacagaaugggaagggauggcgggugcagccacaggaggaaacccagaacuucuugaugaaaucgcacgaguucugaguguauucaaagauggagaugagguaacagcggaacucuggaaauuaccacuaccaggaggaaaggcuaugauagaugcguuaucugaaauaaguuuugauaaauuucaugcauuaucauuaaaagcccucagaaaaauaguaccccauauggaaucgggccuacgauacgaugaggcaugugcaguggcagguuaucaucauagccaguuacacgcugccggagcuggagaacacaaauuucugccgcccuucuauucaagacgagauaaagauggacgaauggucuuuaaugaagaauuagauguaccccgaaauccuguuguucuacgagcguuaaaccaagcgaggaaaguauugaacgcccuaguacggaccuauggcucaccuacagcuguacacauugaaauggcaagagaucuaucuagaccccuggaugaaagaaacaaaguaaagaaagcucaagaugaauaccgcgaacguaacgaaaaagauaaagcugcauuugcagcugaauaugguauugccccuaaaucucgagaauuugaaaaauuucaacuauacagagagcaacaaggaaaaugugcauauucuuuaaaaagccuagaucugcauagaguccugcacgacaucggauaugcagaaguagaucacgcucuaccguauagucgaucauacgacgauagcaaaaacaauaaaguacuagcguuaacggaagaaaauagaaauaaaggaaauagaacagcuuacgaauacuuaaccucauuuccaggcggagaaaauggagaaagauggagaaauuuuaguguugccguugaaacaaauaaagcauacagacuagcaaaaaggacacgauuauuaagaaaagauuucaguggcagagcagcagaagaauuuagagaacgcaaucuuaaugacacaagauacaucugccgauucuuuaaaaacacaguugaacgguuucuaaaauuagaugcaaaaguaggagcaggagauacagcagaaauuagugcaaaaaggugcguaguacugaguggacaaaccacagcauuuuuaagagcuagauggggauuacuaaagguaagagguaauagugacagacaccaugcauuagaugcugcgguaguagcagcguguucacaugguaugguaaagagauuaggugauuauaguaggacuaaggaauuagcuaaaguccaugauggauuuccagacccagagacaggagaaauaauagaucccgugauguuucaacaacuucaugcgcauuucccagaucccuggccgcauuuucgggcggaacuugaggcuagacuaaacgucgaugauacagccgauuuaagagcacgaauggaauuauuuggcacauacgccccugaagcucuugaaaccuuacgaccuuuauuuguaagcagagccccacagaggcgaaauucaggugcagcccauaaagacacgauuuaugcucaacccgaaagauuaaaagaacaaggggguguaacacaaaaaguuccacucaccucguuaacauuaaaagauuuagauaaauuaauagacccucacagaaacgaaaaacuuuaugccgcaaucagggccagguuagaagcacauggaggaaaagcagauaaagcauuucccgcaggcaacccuuugcgaaaaccugaucgcgaaggaaaucccacugguccaguaguacgaacuguaacuauggucauagauaaacuauccggcaucccuguaagaggugguauagcuaaaaaugacacaauguuaagaguugauaucuuuagacacaagaaagauggcaaauuucauuugguaccaguauaugucuaucacgcaguugcaaaagaauuuccaaaucgggccauuguacaagcuaaagaugaagaugaauggacauuaaucgaugacaaauuugauuuuuguuucucugcgcauccaaacgaccugcuaaagauaacacagaaaucuggagaaacaauauucggguauuaccgaggaugucacucagggaccgcugcaauaaauauagcacuacaugauagauaugcauaugccgagaaaacaacaaguuuggcauucucgaaaaagaacccuggaaaaccgauaccuaaugacaaacuuggcuuaauagaaggcauugguguaaaaauggcugccaauauggaaaaguuucauguagauacauuaggaaauauauauccagcaccaccagaacaaagacgugggcuagcauga

SEQ ID NO: 5174 - RNA, 3441 nt, Artificial Sequence
  Cas9 variant
auggcguacagacuuggucucgauauuggaaucacaaguguaggcugggccgucgucgcuuuagagaaagacgaaucaggacuuaaaccuguuagaauacaagaccuaggcgugagaauuuucgauaaagcagaggacucaaaaacaggagcaucacuggcacucccaagacgagaggcaagaagcgcaagacgaaggacucgcaggaggcgccaucgacuauggagagugaaacguuuacuagaacaacauggaauauuaagcauggaacaaauagaagcacuauaugcacaacguacaucaucaccagaugucuacgcacuaagaguagcgggacuggaccgauguuuaaucgcagaagaaauagcgagaguauuaauacacauugcacacagaagaggcuuucaaaguaaucgaaaaagugaaauaaaagacagcgaugcaggaaaacugcuuaaggcugugcaagaaaaugagaaccuaaugcaaaguaaagguuaucgaacuguugcagaaaugcuaguaucagaagcaacaaaaaccgaugcagaagggaaguuagugcauggaaagaaacaugguuauguaucaaauguacgaaauaaagcgggugaguacagacacacaguaaguaggcaagcaauaguggacgaaguaagaaaaauuuuugcagcacaacgagcuuuagguaacgacguuaugucggaagaacuagaagauagcuauuuaaaaauucugugcucucaaagaaauuucgaugacgguccaggaggggauagcccauauggacacggaucaguaucaccggacggaguacgacaaucaauuuaugaacgaaugguaggaucguguacauucgaaacuggcgagaaaagagcaccccguucaaguuauucguuugaaagauuucaacuacuaacaaaagugguaaaccuacgaaucuauagacaacaagaagauggcgggagguacccaugcgaauuaacacagacagaaagagcaagagucauagauugcgcuuaugagcaaacuaaaauaaccuaugggaaauuaagaaaacuacuagauaugaaagacacagaaaguuuugcaggacugacuuauggacuaaauaggucuagaaauaaaacagaagauacuguuuucguagaaaugaaauuuuaucacgaaguucgcaaagcguuacagagagcuggaguuuucauacaagaccuaucuaucgaaacguuagaucaaauuggcuggauacuaucaguauggaaaagcgacgauaacagaagaaagaaacuuaguacacuaggacuaucagauaacguaaucgaagaacuacuccccuuaaacggaagcaaauuuggacaucuuucauuaaaagcaauaaggaaaauacuacccuuucuggaggauggcuauucuuaugacguagcaugcgaacuagcagguuaccaauuccaagguaaaacagaguauguaaaacaacgacuuuugccaccccucggagaaggagaaguuacaaacccaguaguaagacgagcucuaucacaagccaucaaagucgucaaugcuguaauuagaaaacacggcucaccggagaguauacacauugaacuggcacgugaauugaguaaaaaucuagaugaaaggagaaaaauugaaaaagcgcaaaaagaaaaccagaaaaauaaugaacaaauuaaagacgaaauuagagaaaucuugggaucagcacacguaacuggaagagauauaguuaaauauaaauuauuuaaacaacaacaagaauuuugcauguauucaggagaaaaacuagacguuacucgacuguuugagcccggauaugcggaaguagaucacaucauuccauaugggauaaguuuugaugacucuuaugauaauaaaguucuaguaaaaacagaacaaaauaggcaaaaaggaaacagaacuccuuuagaauaucuccgagauaaaccugaacaaaaagcgaaauuuauagcauuggucgagagcauaccccuaucacagaaaaagaaaaaucaucuauuaauggauaaaagagccauagaucuagaacaggaaggauucagagaaagaaaccuaucagauacucgauauauaacccgagcgcucaugaaccacauacaagccuggcuacuauucgacgaaacugccucaacaagaagcaaaaggguaguuugcguuaauggugccguuacagcauauaugagagcaagguggggcuugaccaaagaucgggaugcuggagauaaacaucacgcugcggaugcagucgucguagcauguauaggggauucguuaauucaaagagucacaaaauacgacaaauucaaaagaaaugccuuagcagauagaaaucgauacguacaacaaguaaguaaaucagaaggcauuacacaauauguggauaaagaaacaggagaaguauuuacaugggaauccuuugaugaaagaaaauuucucccaaacgaaccuuuagaacccuggccuuucuuucgagacgaauuauuagcaagguuaagcgaugauccaucuaaaaacauuagagcuauaggacuguuaacuuauucugagacagaacaaauagauccuauauuuguuagcagaaugccuacgagaaaaguaacuggcgcagcccacaaagaaacaauaagaagucccagaauaguaaaaguagacgacaauaaaggcaccgaaauacaaguaguaguaucaaaaguugccuuaacagaacuuaaacuuacaaaagacggagaaauuaaagauuauuuuagaccagaagaugauccaagacuuuauaauacccuacgagaaagauuaguucaauuuggaggagacgcaaaagcagcauuuaaagaaccgguauauaaaauaaguaaagaugguucaguaagaacaccuguacggaaaguaaaaauacaagaaaaacuaacuuuaggcgucccaguacauggaggucgugguauugcagaaaaugguggaauggugagaauagacguauuugcuaaaggcggcaaauacuauuuuguaccaauuuauguagcggauguguuaaaacgugaauuaccuaaccgccucgcgacagcacacaaaccauauagcgaauggagaguagucgacgacucuuaccaauuuaaauucagucuauauccaaaugaugcagucaugauuaaaccaaguagagaaguagauauaacauacaaggacagaaaagaaccaguagguugcagaauaauguauuucguaucagcaaauauagcgucagcaaguauuagcuuaagaacccaugauaauucaggagaauuagaaggauuagggauacaaggacuagagguauucgaaaaauauguaguagggcccuuaggcgacacucacccaguuuauaaagaaagaagaaugcccuuuaggguagaaagaaaaaugaacuga

SEQ ID NO: 5175 - RNA, 3441 nt, Artificial Sequence
  Cas9 variant
auggcauacagguuaggucuagauauuggaauuacaucaguaggaugggcggugguagcauuagaaaaagacgaaucgggacugaaacccgugagaauacaagaucugggaguacgaauuuucgacaaagcugaggacaguaagaccggagcgucgcuagcacuaccucguagagaagcucguagcgcaagaagacguacgcgaagaagaagacauagacuauggcgagugaaaagguuauuagaacagcacggaauauuaucaauggaacagauugaggcucuauacgcacaacgaacaagcucaccagaugucuacgcauuaagaguagccggccuugacagauguuuaauagccgaagaaauugcacguguuuugauacacauagcacaccgaagaggauuucaaaguaauagaaaaucagaaauuaaagacagcgaugcagguaaauuguuaaaggccguacaagaaaacgagaaucucaugcaaucaaaaggauacagaacaguagcugaaaugcuaguaucugaagcaacgaaaacagacgcggaagguaaauugguucauggaaagaaacacggauauguaaguaacgugcggaauaaagcuggagaauauagacauacaguaucaagacaggcaaucguagaugaaguacgaaaaaucuuugccgcacaacgagcuuuagguaaugacguaauguccgaggaacuagaagacucauaucuuaaaaucuuaugcagucaaagaaauuucgaugauggaccaggaggagauucacccuauggccauggcucuguaucaccggauggaguacgucaaucgauuuacgaaagaaugguaggaucauguacauucgaaacaggagagaaaagagcaccacgaaguucauacagcuucgaaagauuccaauuguuaacgaaaguaguuaauuuacgaaucuacagacaacaagaggacggaggcagauauccaugcgaacuuacccaaaccgagcgagcacgaguaaucgauugugcuuacgaacaaacuaaaauaacauacgguaaacucagaaaacuacuagacaugaaggauacagaaaguuuugcaggucucaccuacggacuaaauaggagcagaaacaagacggaagacacagucuuuguagaaaugaaauuuuaucacgaaguuagaaaagccuugcaaagagcaggaguuuuuauacaagacuugagcauagaaacucucgaucaaaucggauggaucuugaguguauggaaaucagacgacaaccgaaggaagaaacuaagcacauuagguuuauccgacaacguaaucgaagaauuacuuccauuaaacgguuccaaauuuggacaccucagccuuaaagccauaagaaaaauuuuaccauuuuuagaagacggauacucauacgacguagcuugugaacuugcaggauaccaauuccagggaaaaacagaauacguuaaacaaagguugcuaccuccucuaggagaaggcgaaguaacaaauccaguaguuagacgagcacuaagccaagcgauaaaaguaguuaaugcaguaauacgaaaacauggaaguccugagucuauacauauugaguuagcaagagaacuaaguaaaaacuuggacgaacgccgaaaaauagaaaaagcucaaaaagaaaaucagaaaaacaaugaacaaauaaaagaugaaauaagagaaauucuuggaucggcucacguaaccgggagagauauuguaaaauauaaacuauucaaacaacaacaggaauuuuguauguacucaggcgaaaaauuagacgucacaagguuauuugaaccuggcuacgcagaaguggaccauauaauaccuuauggcauaaguuuugacgauaguuacgauaauaaaguucuaguaaaaacugaacaaaauagacaaaaagguaacagaacaccauuagaauauuuacgagauaaaccugagcaaaaagcaaaguucauagcacuuguagaaucuauacccuuaagucaaaagaagaaaaaccaucuauuaauggauaaacgagccauagaucuagaacaagaaggcuuucgugagagaaacuuaagcgauacuagauacauuacacgagcauuaaugaaucauauucaagcauggcuuuuauuugaugaaacagccucgacacgaucaaaaagaguaguaugcguaaacggugcgguuacagcauacaugagagcaagauggggauuaaccaaagacagaaacgcuggggauaaacaccaugcagcagacgccgucgugguggcaugcauaggagauucccuaauacaaagaguaacuaaauaugacaaauuuaaaagaaaugcauuagcagauagaaacagauauguacaacaggucucaaaaucugaagguauaacgcaauauguugauaaagaaaccggagaaguauuuacaugggaaucauucgaugaaagaaaauucuuaccaaaugaaccauuagaaccauggccuuucuucagagacgaauuauuagcacguuuaucagaugauccuucgaaaaacauacgcgcuauaggguuauuaacguauucagaaacagaacaaauagauccuauauucguaucucgaaugccgacgcggaagguaaccggugcagcucauaaagagacaauuagaaguccucgaauagucaaaguagacgauaauaaaggaacagaaauucaaguaguuguaucuaagguagcauuaaccgaacucaaacuaacgaaagauggggaaauuaaggauuacuuuagaccagaagaugauccacgacucuauaauacgcucagagaaaggcuuguucaauucggaggagacgcaaaggcugcauuuaaagaaccagucuauaaaauuucgaaagauggaagugucaggacgccaguaagaaaaguuaaaauacaagaaaaguuaacauuaggaguaccuguucacggaggaagagguauagcagaaaauggggguaugguucgcaucgauguguuugcaaaagaugguaaauauuauuuugugccaauuuauguagcagauguacuaaagagggaacuaccaaaucgcuuagcuacagcacauaaacccuacagcgaauggagaguagucgacgauucauaucaauuuaaauuuucauuauauccgaaugacgcaguuaugaucaaacccucaagggaaguagauauaacguauaaagacaggaaagaaccuguagggcuuagauuaauguauuuugcuggugcugacauaucaggagcaacccugacgcuccgaacucaugacaauucuggagaauuaaaaggcuuaggcauucaaggacucgaaguauucgaaaaguacguuguaggaccuuuaggggacacacacccaguuuauaaagagcgccgaaugccauucagaguagagagaaaaaugaacuga

SEQ ID NO: 5176 - RNA, 3447 nt, Artificial Sequence
  Cas9 variant
augacaaaauuaaaucaaccauauggaauaggacuagacauuggaucaaacucuaucggauuugccgugguagaugcaaacucccaccuacuaagacuuaaaggcgaaaccgcaauaggagcuagacucuuucgcgaaggacaaucagcagcagaccgccgcggcucgagaacaaccagacguagauuaucucgcacaagauggcgacuaucauucuuaagagacuuuuucgcaccacacauuacaaaaauagauccugacuuuuucuuacgccaaaaauauagcgaaauuuccccuaaagauaaagacagauucaaauaugagaaaagauuauucaacgauagaacagaugcagaguucuacgaagcauacccauccauguaucaccuucgacuacgacuaaugacugacgccucacaagcagaucccagagaaaucuuucuagcgauucaucacauacucaaaucacgaggacacuuucuaacaccuggcgcugcuaaagacuuuaacacagacaaagucgauuuagaagacauauucccagcauuaacagaagcauacgcacaaguuuauccugaccuggaauugacauuugaucuagccaaagcagacgacuuuaaggcaaaacuacuagaugaacaagccacaccauccgacacacaaaaggcuuuaguaaaucuacuccuaagcuccgauggagaaaaagaaauaguuaaaaagagaaaacagguacugacagaauuugcaaaggccaucacaggacuaaagaccaaauucaacuuggcacuaggaaccgaaguagaugaagcggaugcaucaaacuggcaauucucaaugggacaauuagaugauaaguggucaaacauagaaacaucuaugacagaccaaggcacagaaaucuucgaacaaauacaagaacuuuauagagcgagauuacuuaacggaaucguaccugcaggcaugucacuuucacaagcaaaaguagcagauuauggacaacacaacgaagaucuagaacuauucaaaacguaccuaaagaaacuaaacgaccaugaacucgcgaaaacaauaagagucauauacgaccgauacauaaauggagacgacgcuaaacccuuuuuacgagaagacuuuguaaaagcauugaccaaagaaguaacagcucaccccaaugaagugucagaacaauuauuaaacagaaugggacaagcaaauuucaugcuuaaacaacguacaaaagccaauggagcgauacccguacaacugcaacaacgagaauuagaucaaauaauagcaaaucaaaguaaauauuaugacuggcuagcuaaaccaaacccuguugaaaaacaucgcgcaaguaaaccauaucagcucgaugaacuccuaacauuuaggauucccuauuacguaggaccuuuaauaacaccuaaagaacaagccaaauccggagaaaauguauucgcguggaugguaagaaaagaccccucagggaacauaacuccauauaauuucgaugaaaaaguagauagagaagcaucagcuaacguuuuuauccaaagaaugaaaaccacagacacauauuuaauaggagaagauguccuuccaaaacaaucucuacuguaccagaaauaugaggucuuaaaugaauugaacaacguacggguaaacaaugaagcauuagguacugaccagaaacaaagacucauuagagaagucuucgaaagacacuccucugucacaauaaaacaaguagcugauaaucuaguugcacauggagauuuugcacaaagaccagaaauacgcggccuugcagacgagaaaagauucuuaucaucuuuaaguacauaucaucaauuaaaggaaauacuacauggcgcaauagaugauucaacaaaacuucacgauauagaaaacauaauaacauggucaaccguauucgaagacgcagcaauauuuaaaaccaaauuagcugaaauagacuggcuagacgccgccacaauuaagaaacuuucaaacauuagguacaggggauggggucaguucucacgaaaacucuuagacggauuaaaacuaggcaauggacaaacaguaauacaagaacucauguuaucaaaucacaaucuaaugcaaauacuaacugacgaaacauugaaaacuacaauggcggaacucaaccaggauaaauuaaaagccgaugauauagaagauguaauuaacgaugcauacacaucaccauccaacaagaaagcacuaagacaaguucuuagaguaguagaagacauaaaacacgccgcuaauggccaagacccuucauggcuauacauagaaacagcugacggcccaggaacagcaggaaaaagaacucaaucaagacagaaacaaauucagacagucuaugcaaaugcggcacaagaauuaauagauucagcaguuagaggagaacuagaggacaaaauagcagacaaagccucauucacagacagauuaguauuauacuuuaugcaaggaggaagagacaucuacacaggcgcaccacuaaacauagaucaacucucacauuacgacauagaucauauccuuccucaaagucuuauuaaagacgauagucuggacaacagaguucucgucaacgccacaauaaaucgagagaaaaacaacguauucaccucaaccuuauucgcaagcaaaauggcugcaaccuggcgaaaguggcaugaagcaggacuuauaucaggucgaaaauuacgaaaccuaaugcuacgucccgacgaaauagacaaguuugcacacggauuuguagcuagacaguuaguagaaacgagacaaauuauuaaacuaacagaacaaauagcagcagcccaauacccuaauacaaaaauaauagcagucaaagcuggucuaucacaccaauuaagagaagaacuggacuuucccaaaaaccgagauguuaaccauuaccaccaugcauuugaugcauuccuagcugcccgaauagggacauaccuccucaaacgauaugcaaaacuagccccauucuucacuuacggugaguucgcaaagguagacguaaagaaauuccgagaauuuaauuuuauuggagcucuuaaacacgcuaagaaaaauauagucgcgaaagacacuggugaaauaguaugggauaaagaacgugacauacaagaacuagauagaauauacaauuucaaaagaaugcuuauuacccacgaagucuauuucgaaacggcagaccucuucaaacaaacuauauaugcagcaaaagauuccaaagaaagagguggcucaaaacaacuaaucccaaagaaacgagguuauccaacacaaguauaugguggcauacacgguaaaauaagacuaacauggagauggcuaaaacuccuaagacgaaagaaaaugucaauagaauuaucugaauuacaacuacuuaaauga

SEQ ID NO: 5177 - RNA, 3450 nt, Artificial Sequence
  Cas9 variant
auggaaagauaccacauaggacucgacauaggaacaucaucaauaggcugggcaguuauaggagacgacuucaaaauaaaacguaagaaagguaaaaaucuaauaggcguacgacuauuuaaagaaggagauaccgcggcagaaagaagaggauuccgaacucagaggagacgccuaaacaggcgaaaauggcgauugaaacuguuggaagaaauuuucgacccuuauauggcagaaguagauaaauacuuuuucgcgagguuaaaagagucaaaccucucgccgaaagauucaaauaagaaauacuuggguagucuacuauuuccggacauaucagauucaaacuuuuacgauaaauacccaacgauauaccaucugcgacgcgaucucauggaaaaagacaagaaauuugaccuacgagaaaucuauuuagcaauccaccauauaguaaaauaccgcggaaauuuucucgaaaaaguaccagccaaaaacuacaaaaacuccggagcaagcauaggauuccuacuagaagaaguaaacgacuuguacggaaauauaauugguaaugaagauguagcaauacucgacaaugacaaauuugaagacguagagaaaaucauacuaaaugacgaaauaagaaacauagauaaacagaaaaauguaggaagauuacucgugaaagacaagaaagagaaaaacauaguuacagcauucuccaaagccauauuuggauacaaauuuaauuuagaagacuuacuacuaaucgaaucagaugagaaaaauaaauuaacauucaacgaugaaaacauagaugauaucuucaacgaacuaucucauucauuaaaugacaaccaaauggaccuacuaacuaaaacaagagaaaucuauuucaaauuuaaauugaacaugauaguaccaacaggauacaccaucuccgaaagcaugauugaaaaauacgaaaugcauaaagcacaccuuaaaauguauaaagaauuuauaaacacauuaaacgcaaaagauaggaaaauacuuaaaaaugcauauagcgacuacauaaauaaugaaaaagcaaaagcagcaaaugcucaagaaaacuucuacaaaaccgucaagaaaacaauaaaagaaaaugauucagauacagccaagaaaauaaucggcuuaauagacgaaggaaauuucaugccgaaacaaagaacaggggaaaacggugugauaccacaccaauuacaucaaauugaauuagaucgaauaauagaaaaucaagccaaauacuacccuuggcuggcagaagaaaacccaguagagaaaaauaggaaauucgcaaaauauaaauuagaugaacucgugacauucagaguaccauacuauguaggaccccucauagacaaaacugaauccaauaaaaacgaaaaagaaacaaaauucgccuggauggugagaaaagcaaaaggaacaaucaccccuuggaacuucgaaaaucuaguagacaggacagaaagcgcaaacagauucauaaaaaggaugacaucaaaagacaccuauauaauaggcgaagauguacuacccgcaagcaguuuacuauacgaaaaauauaaaguacucaacgaauuaaacaacaucaaaguaaacaaaaagaaacuagacguagaacaaaaacaacacgucuaccuagacuuauucacuacccgcaaaaacgucacgaaagacgaucuagccacaucauuaaacugugauguagaaucaauaacaggucuaacagauaauaagaaauucaacucgaguuuaaguaguuauauagaccucaaagcaauacuaggaaacaucguggaugacuauagcaaaaaugaagacuuagagaaaauaauagaauacuccacaauauucgaagacggaaacaucuauaaagaaaaacuauccgaaaucucaugguuaacagacgaacaaaucgaaaaacuaucaaacauucacuucaaaggauggggaagacuauccaagaaacuauuaacacaaauaacaaacgaaaacggcgaaaggauuauagacacacucuggaauaccaguaacaacuucauacaaguaauaucugacgaaagcauccaagcaaaacuagcagaaauaaacggggaauacgcgaacaaauacaacuuggaagauauacucgaugaagccuacacaucaccucaaaacaagaaagcaauaagacaagucaugaaaguaguagaagacauugaaaaagcaaugaaaugugaaccgaccucaauagcaauagaguucacuagagagaaaaggaaaucaaaauuaacaaauacacgauacaagaaaauaucagagaccuacgagaaaaucacugaugaauuaauaagcgaauacgaacuuggaaaauugcaaucagaacuagacucuaaaguuaauaauaugagagauagauauuaucuauacuucaugcaauuaggacgagauauguauacaggggagaaaaugaauauagacgaauuacaccaaaaauaugauauugaccacauauuaccacaaucauucauaaaagacgacagccuaaacaacaggguacuaacuucaaaaucaguaaacaucaaagaaaaauccgauaaaacagcggcugaccuauacgccgcaaaaaugggagacuuuuggcggaaacuacggaaacaaggccuaaugacugaacaaaaauacaaaaaccuccuaacgagaacugauucaauaaauaaauauacuaaacaaucauuuauuaaaagacaacuuguagaaacaagucaaguagugaaacuagcagcaaauauacuccaagacaaauacagaaauacaaaaaucauagaaauacgagccagacucaauagcgaucuuaggaagaaauacgaacuuaucaaaaacagagaagugaacgacuaucaucacgcaauagacgguuacuuaaccaccuuuguaggacaauaucuauacaaaguauaccccaaauuacgaucauauuucgucuaugaugacuuuaagaaauuagauucaaacuaucucaaacacauggacaaauucaauuucaucuggaaacucgaagauaagaaagcagaagacguauacgacaaagucaacgacgaguucguccucaauguaccagaaaugaaagaguacauccgaaagauauauaauuauaaauacauguuaguaucaaaagaaguuacaaccaaaaauggagcauucuaugaccaaaccaaauauaacgcuaaaacaauaaauuuaaucccaaucaagaaagacaaaccuacaaacaucuacggaggauacaaagguaaaguuagcucguacaugauguuaguuaagauccagaagaagaaagaaguaauauauaaauucguaggcguaccucgccuauggacugaugaauuagacaggcuaauugacaccgacgaaaagaaagcacuuuuaaagaaauga

SEQ ID NO: 5178 - RNA, 3459 nt, Artificial Sequence
  Cas9 variant
augaacgcugaacauggaaaagaaggacuacuuaucauggaagaaaacuuucaauaucggaucggauuagauauaggaaucacaagcguaggaugggcaguacuacaaaauaacagccaagaugaaccaguacgaauaacagaccuaggcguuagaauauucgauguagcagaaaauccuaaaaauggagaugccuuagcagcuccaaggagagaugcaagaacaacacgaaggagacuaagaagaagaagacauagacuagaaaggauuaaauucuuauuacaggagaauggcuugauugaaauggacucauucauggagagauauuauaaagggaaccuaccagacgucuaucaacuaagguacgaaggacucgauagaaaacuuaaagaugaagaguuagcacaaguuuugauacauauagcgaaacauagaggauuuaggucgacaagaaaagcagagaccaaagagaaagaaggcggggccguguuaaaagcaacaacagaaaaucaaaagauaaugcaagaaaaaggauaccgaacaguaggugaaaugcuauauuuagacgaagcauuucauacagaaugccuguggaacgaaaaaggauacguacucacaccaagaaaucggccagaugauuauaaacauacaauacuacgcaguauguuaguggaagaagugcacgcgauuuucgcagcucaaagagcacacggaaaucaaaaagcaacagaaggacuugaagaggcuuauguagaaauuaugaccagccagagaucuuucgacauggggccaggacuacagccagauggaaaaccuaguccauaugcuauggaaggauuuggagacaggguuggaaaaugcacauucgaaaaagacgaauauagagcaccgaaagcuaccuacacagcagaauuauuuguagcgcuacagaaaaucaaccacacaaagcuaauagacgaguucggaacaggaagauucuucucagaagaagaaagaaaaacaaucauaggauuauuauugagcucuaaagaguuaaaauaugggacaauaagaaagaaauuaaacauugacccgagcuuaaaauucaauucauuaaacuauagcgcaaagaaagagggugaaacagaagaagaacggguacuagacacagaaaaagcuaaauuugcaucaauguuuuggacauacgaauacucuaaaugucuaaaagacagaacagaagaaaugccuguaggugaaaaagcugaucuauucgacagaauaggcgaaauauuaacagcauacaaaaaugaugauucuagaucaaguagacuaaaagaauugggacuaucaggugaagaaauagacgguuuauuagauuugaguccagcaaaauaucaaagagucucacuuaaagccaugaggaaaaugcaaccuuaucuagaagauggacucauuuaugauaaagcaugugaagcagcaggauaugauuuuagggcucuaaaugauggaaacaagaaacaucuauuaaaaggagaagaaauaaaugcaauaguaaacgacauaacaaacccagucguaaaaagaucaguaucacaaacaauuaaaguuauaaacgcaauuauacaaaaauauggcagcccacaagcaguaaacauagagcuggcucgagaaaugucuaaaaauuuucaagauagaacaaacuuggaaaaagaaaugaagaaaagacaacaagaaaaugagagagcaaaacaacaaaucauugaacuuggaaaacaaaacccaacaggacaagauauccuaaaguauagacuauggaacgaucaaggaggcuacugccuuuacaguggaaagaagauuccacuagaagaguuauuugacgggggauaugacauugaccauaucuugccguacaguaucacauuugacgacaguuauagaaauaaaguauuaguaacagcacaagagaaucgacaaaaggggaaucggaccccguacgaauauuucggcgcagacgagaaaagaugggaagauuacgaagcgagugugaggcuauuaguacgggacuacaagaaacaacagaaauuacuaaagaaaaacuuuacagaagaagaaaggaaagaauuuaaagaaagaaaccuaaaugacacaaaauauauaacuagaguuguauacaauaugaucagacaaaaucuagaacuagaaccauucaaccauccugaaaagaagaaacaaguaugggcagucaauggagcaguaacaagcuaucuaagaaaaagauggggauuaaugcaaaaagaucgcucaacugacagacaccaugcaauggaugcaguaguuauagcaugcuguacagacggaaugauucauaaaauaucaagauauaugcaaggaagagaauuagcauacagucgcaauuucaaauuuccagaugaagaaacgggugaaauacuaaacagagauaauuuuacuagagaacaaugggacgagaaauuuggaguaaaaguaccucuuccauggaacagcuuuagagaugaauuggacauaagacuguuaaaugaagaccccaaaaauuuccugcucacacaugcugacgugcaaagagaauuagacuauccaggguggauguauggagaagaagaaucgccuauagaagaaggaagguauaucaauuauauuagaccauuauuugucagcaggaugccuaaucauaaaguaacuggaucagcacaugacgcaacaauacggucagcaagagauuacgaaacccgaggaguagugauaacaaaaguuccacuaacagaucuaaaacucaauaaggauaacgagaucgaaggcuacuacgacaaagacagcgauaggcuacuuuaucaagcgcuagucagacagcugcuacuacaugguaacgauggaaagaaagcauucgcagaagauuuucacaaaccgaaagcagacgggaccgaagguccagugguaagaaaaguaaaaauagaaaagaaacaaacaagcggcgugaugguuagaggaggcacuggcauagcagcaaauggcgaaaugguaagaauagauguauucagagaaaacggaaaauauuauuuugucccuguauacacagcagaugucguuagaaaaguauuaccaaaucgagcagcaacacauacuaaaccauacucagaauggagagugauggaugacgccaacuucgucuuuucacuauauucuagagaucuaauacacguaaaaagcaaaaaggacauuaaaacgaacuuaguaaauggaggucuacuauugcaaaaagaaauauucgcauacuacacaggagcugacauagcaacagcuucuauagcaggguuugcaaacgauaguaauuuuaaauucagagguuuggggauacaaagucuagaaauauucgaaaagugucaaguugacauacucggcaacaucagcguagucagacaugaaaauaggcaggaauuucauuga

SEQ ID NO: 5179 - RNA, 3462 nt, Artificial Sequence
  Cas9 variant
augaaaaacauacuaggacuagaucuuggauuaucaucgauaggcuggucgguaaucagagaaaacagcgaagaacaagaauuaguagcgaugggcagccgcgucguaucauuaacagcggcagaacuaagcucuuuuacccaaggaaacggaguaucgauaaauagucaaagaacacaaaaacgaacacaaaggaaaggauacgauagauaucaacuaagaagaacauuacuucgaaauaaauuagacacucuagguaugcugccugaugauucauuaucauacuuaccaaaacuacaacuauggggacuuagagccaaagcaguuacucagagaauugaguuaaaugaauuaggcagagugcuccuucaucugaaccaaaaacgaggauauaaaagcaucaaaagcgauuucucaggcgacaaaaagauuacagacuacguaaaaacaguaaaaacaagauacgaugaauugaaagaaaugagauuaacaauuggcgaacuguucuuucgaaggcuaacagaaaacgcauucuuuagauguaaagaacaaguauacccacgacaagcauacguagaagaguuugauuguauaaugaacugucaaagaaaauucuacccagauauacuaaccgacgaaacaauaaggugcauaagagacgaaauuauauacuaucaaagaccccucaaaaguuguaaauaucuaguaagucgaugcgaguucgaaaagagguuuuauuuaaaugcagcgggaaagaaaacugaagcuggcccaaaagucucacccagaacaagcccccuauuccaggucugcagauugugggaauccauaaacaauauaguaguaaaagacagacgaaacgaaauaguguuuauauccgcagaacagagagcugcacucuuugauuuccuaaacacccaugaaaaacucaaaggaucagauuuauuaaaauuacugggauuaagcaaaaccuacggauauagauuaggcgaacaauuuaaaaccgggauccaaggaaauaaaacccgaguagaaauagaaagagcucuaggcaauuauccugacaagaaaagauuacuacaauucaaucuucaagaagaaagcuccagcauggucaacacagaaaccggcgagauaauaccaaugauaucuuuaucauucgaacaggaaccacuuuauagguuguggcacguuuuguauaguaucgaugauagagaacaauuacaaucgguauuaagacagaaauucggaauugacgaugacgaaguauuagaaagauuaagugcgauugaccugguaaaagccggauucggaaacaaaaguucaaaagcuauccgacgaauacuaccauuucuccaauuggguaugaauuacgcugaggcaugugaagcagcagguuauaaucauucaaauaacuacaccaaagcagagaacgaagcaagagcucugcucgaucgacugccagcuauaaagaaaaacgaauuaagacaacccgucguagagaaaauacuaaaucaaaugguaaaugucguaaaugcccucauggaaaaauacggacgcuuugaugaaauaaggguagaauuagcaagggaguuaaaacaaucaaaagaagaaagaucaaauacauauaaaucaauuaacaaaaaccagagagaaaaugaacagaucgcaaaaaggauaguagaauacggaguaccaacaagaucaagaauccaaaaauauaaaaugugggaagaaucaaaacauuguuguauauacuguggacagccagucgacguaggagacuuuuuacgagguuuugauguagaaguugaacacaucauacccaaaucauuauacuucgacgacucauuugcgaauaaagucugcucguguagaucaugcaauaaagaaaagaauaauagaacagcauaugauuauaugaaauccaaaggagaaaaagcacuaagcgauuacguagaacgaguaaacacgauguacacaaacaaucaaauaaguaaaacaaaguggcaaaauuuacuaaccccaguagacaaaauuaguaucgacuuuaucgacagacaauuaagagaaucacaauacauagcaagaaaagcuaaagaaauacuaacaaguauaugcuauaauguaaccgcuacaaguggaucagugacuagcuuuuuacgacauguauggggaugggacacaguauuacaugaucuaaauuucgaucgcuauaagaaagugggacuuacagaaguuauagaagugaaucaccgaggaagcguaauacgcagagaacaaauaaaagacuggucuaagagauuugaccaccgacaccaugccauagaugcccuaacaaucgcauguacaaaacaagccuauauacaacgacucaauaaucuuagagcagaagaagguccugacuucaacaaaaugucccucgaaagauauauacaaagucaaccacacuuuagugucgcacaagugagagaagcgguagaucgcauccuagugagcuuccgagcagguaaaagggcaguaacaccaggaaaaagauacauaagaaagaauagaaaacgaauuucaguacaaucgguauuaauaccuagaggugcacuaucugaagaaucaguuuauggcgugauacacgucugggaaaaagaugaacaaggacauguaauacaaaaacaacgcgcaguaaugaaauaccccauaacaucuauaaaucgagaaauguuagauaaagaaaaaguuguggauaaaagaauacaccgaauauuauccgggcgauuagcacaauacaacgauaacccaaaagaagcguuugcaaagccaguauauauugauaaagaaugucggauaccuauuagaacuguacguugcuucgcaaaaccugccauaaacacucuagugccgcuaaagaaagaugauaaagguaacccgguagcauggguaaacccaggaaauaaccaucacguagcuauauaucgcgacgaagacggaaaauauaaggaaagaacuguaacuuucugggaagcugucgaucggugccggguuggaauaccagccauaguuacacaaccugauacuauuugggauaauauacuacaacggaaugacauaucagagaauguacuggaaucauuacccgacguaaaauggcaauuuguauuaaguuuacaacaaaaugagauguucauauuaggaaugaaugaagaagauuauagauaugcgauggaucaacaagauuaugcacuacuaaacaaauaucuauauagaguacaaaaauuaucaaaaucagacuacaguuuucgcuaucauaccgaaacaagugucgaagacaaauacgacggcaaaccuaauuuaaaacucagcaugcaaaugggaaaacuaaaaagagucucaauaaagagcuuacuaggucuaaacccacacaaagugcacauuaguguacuaggggaaauaaaagagauaucuuga

SEQ ID NO: 5180 - RNA, 3474 nt, Artificial Sequence
  Cas9 variant
augaauuacuauaacgguuucauaauaacagaaaacgcuaugacauccaaacaagaaaaacacggagcacuaacauucgggcuugacauagggauugccagcgucggaugggcaguauuaggagaaucucgaauuguagauuuaggaguucgauguuuugauaaagcugaaacagcaaaagaaggcgaaucacugaaucugacaaggcgcauggccagacuucuaagaaggagauugaggcgcagggcauggagacuuacuaaauuagcuagacugcuuaaacgagaaggguuaauagcagacgcaaaucucuuuaaacacaaaauagagaaaaauaccccuguaccaaaaaguucauggcaacucagaguugacggcuuagacagacaauugaaugcugaagaaugggcuagaguaauauaccaucuguguaaacauagaggauuucauuggauauccagagcagaagaaaaagcggccgaaggcgauaguaaaggugaaggaggaaaaguaaaacaaggauuagcgggaacaaagaaacuaaugcaagaaaaaucauaucgcacagccgcagaaauggugcuugcugaauuuccagacgcacaaagaaacaaacaaggcgauuauucaaaagcucugagcagaauauugcuaggggaugaacuaaaagcccuauuugaacaccaaagaaaacuagggaauccaguggccaccgaaaaauuagaagcagcaauuuuagguaacggugauaagaaauguggccuauuuugggcacaaaauccagcccuggccggaaauaaauuauuagaaauguuaggaagauguacguucgagaaaacaggaggagacgauggcaaaggagaauauagagcaccaaaggcuucuuucagugcggaaagacacguauggcuuacacaucuuaauaaucuacgaauaguagucgauggcacaacccgaccauugaacgaagccgaaagacgggucgcacuaccuaugccauaccaacaagcaggcgauuuaucauauaaacagcuaggaggagcauuaauuaaagaagguuuucuccaaaaagauggauucaaauucgcaggauuaccauauccuacaaaacaagcaucagaagaaaaagcaaaagauccagaaacaagugucuuguguaaauuaccagcguggcauacuuuaagaaaaacauuagaaaaacacgguuuagaaagcgaguggcaaaaacuaucuacagaugcauuagacggaaagccacaacuacuagacaacauugcguggguuuuaucuguauauaaagaugaugaugaaguaaaaacagaacugggaaaguuaaaucuuccaaacacagagaaaaugauagacgcauuauuagacauaagauuugauaaauuuucaaaucuaagucuaaaagcauuaucuaaaaucguaccauuuauggaacaaggacaacgauaugaugaagcagucgcaaauauaccagaauacggacaccauagucaacuacacaaaguaggagcgggagaacauaaauaucucccaccguuuuacaaggaaagagauaagacaggaagaaugguguuuaaugacgauauggauaucccgagaaacccaguugucuuaagggcauuaaaccaagcaaggaaaguaguaaacgcucuuauuaaagaauaugguaguccgcaugaaguacauauagaaauggccagagauuuaaguagaccauuagaugaacgucgagauauagagaaauuacaaaaagaauuuggggaaagaaauaagaaagacaaagaacuuuuugcacaggauuuuaacauaguaggaacaguuaaaggaaaacaauuugaaaaguaccaacucuaccgagaacaacaaggcaaaugcauauauccuaguauggacgaaaaacaggggaucugcuguuauucgcuaaaaccacuagacuuacauagagucuuauacgaagaagguuacgcugaaauugaucaugcauugccguacucccguucuuuugaugauucuaaaaacaacaggguauuaguccuagcaaaagaaaacagagauaaaggcaauagaacccccuuugaauaccuaggagauaaagauaauucagaaccauggcgucaauuuguagccuucguugagggaaauaaagcauaccguuuagcaaaacgaagucgguuauuaaggaaagacuucggagacaaggaagccaaagaauuuagagaacgaaaccuuaaugauacucguuauauaugcaaauucuuuaagaauuauguagaacaauauuuacaacugcacgaagacucggaagcuaaacgaugcgucguacuaaguggccaaaugacaucuuuucuaagagcaagauggggacugguaaaaguaagaggcgacucagauagacaccaugcucuagaugcugcaguaguugcagcauguagucacggcauggucaaacgacuaucagacuacagcagaagaaaagaauuggagcaaguucgagaaggauuugucgacguagauacaggagaaauaguuaaccccgccauguuucaacaaguucaagaacacuuuccuaacccguggccacacuuuagagaugagguuaaauugagauuaagcauagaugauccaacucucuugagaagugaaauggaaaaauuuggaacauacacaccagaaucacuagaagcauuacguccuuuauuuguaaguagggcaccucaaaggagaaauagcggagcagcucacaaagauacuauauaugcgcaacccaaaagacucgucgcacagggcgguguuacacaaaaaguugcccugagcucauuaacuuuaaaagaccucgauaaauuaauagauccucaccgaaaugaaagauuauacgccgcuaucagagcuagacuagagcaacacggcggcaagggagacaaagcauuuccagcaaguaaucccuuaaggaaaccugauagugaaggaaauccaacgggccccaucgugcgagggguaacaaugguaauugacaagcuaucggguauaccuauuaggggaggaauagcuaaaaaugacucaaugguacgcguagacguuuuuacuaaagcaaauaaauuucaucuaguacccguauauguucaucacuccguguuaggacuaccaaaucaagcaauagucggugguaaagaagaaucagaauggacucaaauagacgauaguuucgauuggcauuucucaauuuauccaaaugacuuaauuagaguuacuuuaaaacaagaagguagauucggauauuaugcaggcugugaccgaagcacggcagcuauacaccuuugggcacaugauagaaaucaacaaguaggcaaagacggguuaauuagaucaauaggagugaaaacagcacuaucuauagaaaaauuuaacguagacguacuuggaaaucgauacccagcaccuccagaaaagagaagagacuuagccuga

SEQ ID NO: 5181 - RNA, 3486 nt, Artificial Sequence
  Cas9 variant
augaagaaaauauugggacuggacuuaggaagugcgucaauagggugggcauuaguagaagaaacagaacaaaugcaauauaauauagucucacuuggaaguaggauaauaccauacaacggaacagaaggacaggaauuugaaaaaggaaccggagaaucaagaaauaguuuaagaacgaaagcaagaacagccagaaaaggauacgauagauaccaacugagaaggaaaaacuuggagaaaauauuacuucaaaauggcauguacccaaaugaacaaguaagagcacuacaaaaacuugaacuguggaaacuaagagccgacgcaccgaacguacaaauauccuuaccggaacuaggaagauuacuuuucugguugaaucagaaaagaggauacaaaagcuccagaucggacgcaaauuuagacaagaaagauacagaauaugucgccacaguaaaaucuagacaccagaaaauaaaagaugcuggacaaacugucggucaauauuucuacgggcaaauauuggaaaacgaauaccacagaauuaaagagcaaguauuuccuagagaggcauauauagaagaguucgacgcaauaguggcgaggcaaaaagaauauuaccccaccauucuuaaacaagaacuaauagauaaaauaagaaacgaaguaaucuacuuccaaagaggacuuaaaagucaaaaaggacucguuucagucugcgaauuugaaggaagagaguucaauggacacuucggcggcccgaaaguagcgccaaaaucgaguccaauauuccaacuaggaaagauaugggaaaacauuaacaacauaaaaauagcugacaucgaacuaacagcugaacaaaaauuaguauucuuuaauuaucuuaacugccaugaaagaauaacagaagcaaaaauaagagaauuacuaaaacuaagcaaagacucaagguugaacggacaauugaaaaacgguuuaacagguaauaaaacguacucucaaauagcaaguuguuuuggaaacaagaucggagaguacgaaagacuauuuaaauuugaauuagaaguaauugagagcgagaaacuugaauacacauaccaucccaaaucucacauacccgugggagagaaaagaagaaaguacauaucugaaaauguugaaaaagaaccuuacuaucgguuauggcauacuaucuauucaauaaaagacaaagacgaaugcagagcagcauuaaucaaaaauuuuggcauagaagaagaaauagcggaaaaacuagcaaguuuggauuucagugcgggaggguuuggaaacaaaugcgccaagguuauaaggaaaauacuaccguaccuaauggaaggggauaaauauaauguugcaauggacuaugcugguuacaaucacucauuuagucaaacuaaagaugaaaaccuccaacgcguacuauuggauagcauaaaucaccuacccaaaaacucauuaagacaaccaauuguagagaaaauacuaaaucaaaugauaaaccugguaaacgaaguaauaaaacaaugggguagaccagacgagauucgcguagaacucgcaagaaaauuaaaacaaucgaaaacagaacgaaaugaugaugacaauuucaugagaaagagagaaagagaaaacgagauaaucaaggcagaccuagcaaaauacggauuaaaagcgacaagaaauaacguaauaaaguggagacuauaucaugaaaucgaugacaaagauaagaaacuuaaugcaaggugcauauauugcggacaacccauaagccuuacagaagccauuuuaggaaacaacguggauguagaacacauaauaccuaaagacaaauuauuugacgacagccaaaguaacaaaacgcuugcgcaccgaucauguaacucgggcaaaggaaacaaaacagccuacgacuuuaugaaagacaaaccacaauuugaggaauacguugcuagaguagaagaauuauacaagaaacauuuaauuucacuuacaaagaaacgcaaauuucugaugagcgaagauaaaaucccaucugauuuuauugauagacaacugagggaaucacaauauaucgcaagaaaaucaagagaaauacuacaaacaguuugcagaaacguauggucuacugauggaggaguaacugcacaccucagaaaauuauggggaugggacgauguaacuaugaaucuacaaaugccgaaauacaaaggaauagggaugacagaaauaguggaaugggaaucaaaccaugggaaaaaucaacauacacaggaaguaauaaaagacuggucaaaaagagacgaccacagacaucaugcuauagaugcgcuuguaguagcuugcacgagacaaggauacauccaaaggauuaauacccuaaacuccagugaaacuaaagaugaaaugcaccguaaaguagcgggguccuuagucgaguucaaucaaaaacauacauuauuaaauaaauaccuuauaacagaaaaaccauuuaccacaucagaagucgaagacguaguaagcaaaauauuaguaaguuucaaagcaggaaagaaagcugcaacacccggcaaaagaaaagugggaaaacgaggaaauaaacaaguaguacaagacggcaucauaauaccacguggagcuuugcaugccgauuccguaucuggaaguauuaaacaauaugacccuacaggcaacuuugaaaaccauaacguaauaaaauauaaaguaggaguuggaaaagguuauuuauuugacggaaaagaugacaaaaagaaaauugauaaaacuauagacugcaucguagacaagaaaauuagagacuuaauaaaacaaagagcggaagaaagcaauuacagccugaagaaaauguucgaaacuccgauauuauuuaaucaaagagcaguauucuccgugagauguaaaaccggaaacaaagcagugguuccaaucagaaacggauacguaguaccugacaauaaucaccacacggccauauacaaauaugacggcggcuuaaaagaacaaugcguuucguuaaugcaagcgauagaaagaaaaagauacaaccuuccuauaauaaucaaaaauccaaaagaaauauacgacaaaauaaccgaaauagcuaacaucaaucaacugcuauucgacagucuaccgaaacuagacugggaauuuguaacgacacuccagaaaaacgauauguuuauccucgggauggacuacagcgccacagaagaagcauuggcugacggcaauuacagacuucuaagcgaauacuuguauaaaguacaaaacauaagugaugguauauauagacuaugucaccauacaauaaccaaauucgauuuaagcaaagcaaacaaaccagacaaaagauucuacaacauacaaucauuaaaagcauggaauacacucaacccacaaaaaguaaaaauaaacauauuagggcaaauagaacgacaauga

SEQ ID NO: 5182 - RNA, 3501 nt, Artificial Sequence
  Cas9 variant
augcauguugaaauagacuucccccacuucucgcggggugauucacaccucgcaaugaauaaaaaugagauauuacgaggcucauccguacucuacaggcuaggacuagaccuaggaucgaauaguuuaggaugguuuguaacacauuuggagaaaagaggugacaggcacgaaccaguugcauuaggaccaggcgguguaagaauauucccugauggacgagauccacaaagcggaaccucuaacgcgguggauagaagaauggcccguggagcuagaaaaagaagggaucgauuuguugaacgacguaaagaauuaauagcagccuuaauaaaauacaaucuacuaccggaugacgcaagagaacguagagcauuggaaguauuagacccauacgccuuaagaaagacagcauuaacagacacacucccagcacaucacguaggcagggcucuuuuucacuuaaaucaaaggagaggauuucaaucaaauagaaagacagacucaaaacaaagcgaagauggcgcaauaaaacaagcagcaucaaggcucgcaacggacaaagguaacgaaacuuuaggaguuuucuuugcagauaugcauuuacgcaaaaguuaugaagauagacaaacagcuauacgugcagagcuaguuagauuggguaaagaucauuuaacaggaaacgcaagaaagaaaauaugggcaaaggugcgaaaaagauuauuuggagaugaaguacucccgagagcagaugcaccacaugguguuagagcuagagcaacaauuaccggcacaaaagcguccuacgauuacuauccaacaagagauaugcucagggaugaauuuaaugcaauaugggccggacaaucugcacaccacgcuacuauaacugaugaagcaagaacagaaauagaacacauaauauuuuaucaaagaccgcugaaaccggcuauaguaggaaaauguacuuuagauccugcaacacggccauucaaagaagaccccgagggauacagggcaccauggagucaucccuuggcacaacgauuucgcauacucagcgaagcuagaaaccuagaaauacgagauaccgguaagggaucuagaagauuaacuaaagaacaaucugacuuaguaguugccgcacuauuagcaaauagagaaguuaaauuugauaaauuaagaacacugcuaaaguuaccagcagaggcaagauucaaucucgaaucugaccgucgagccgcauuagacggagaucagacugcagcaagacuaagugauaagaaagguuuuaacaaagcauggagaggcuuucccccagagagacaaauagcaauuguagcaagauuagaagagacagaagacgaaaaugaacuuaucgcaugguuagaaaaagagugugcauuggacggagcagcugccgcaagaguugcaaacacaaccuuaccagacggucauugucgguuaggacuacgggcuauaaagaaaauuguuccuauaaugcaagacggguuagaugaagauggaguugcuggagcagguuaucauauagcagcaaaaagagcgggauaugaucaugcaaaauuaccaacaggagaacaauuaggaagauuaccauacuacggacaauggcuucaagaugcaguaguagguaguggagacgcuagagaucaaaaagaaaaacaauacggacaauucccaaauccaacuguacacauaggacuaggccagcuuaggaggguaguaaacgaccucauugauaaauacgggccuccaacagaaauaucuaucgaauuuacaagagcccuaaaauuaucggaacaacagaaagcagaaagacaaagagaacaaagaagaaaucaagacaaaaauaaagcccgcgcagaggaacucgccaaauuuggcaggccagcaaauccaagaaaucucuuaaaaaugagauuaugggaagaacuggcccacgacccacuagauagaaaaugugucuauacuggcgaacaaauuucuauagagcgacuauugucagacgaaguggauaucgaucacauauuaccaguugcaaugacacucgacgauucgccagcaaacaaaaucauaugcaugagauacgcaaaccgacacaaaaggaaacagacgccaucugaggcuuuuggcaguucgccaacccuacaaggucacagguauaauugggacgacauagcagccagagcaacaggcuuaccuagaaauaaaagguggagauucgaugcaaaugcaagagaagaauuugauaaaagaggaggauucuuagcucgacaauuaaaugaaacgggaugguuagcaagacuggcgaaacaauacuuaggagcaguaacggauccuaaccagauuuggguuguacccggaagacucacaucaaugcuacgcgguaaauggggcuuaaauggauuacucccuagcgacaauuaugcaggaguacaagauaaagcagaagaauuucuagcaaguacggaugauauggaauuuagcggggucaaaaauagagcagaucauagacaucacgccauagauggacuuguaacugcacuaacagacagaaguuugcuguggaaaauggcaaaugcguaugaugaagaacaugagaaauuugugauagaaccaccauggccuacuaugcgagaugacuuaaaagcugcauuagagaaaaugguagucagccacaaaccugaucauggaaucgaaggcaaacuacacgaagacucugcauacggauuuguuaaaccauuagaugcaaccggauuaaaagaagaagaagcagguaaucugguguauagaaaagcaauagagagucucaacgaaaaugaaguagauagaauccgcgacauucaauugaggacuauugucagagaucacguaaacguagagaaaacuaagggaguggcacucgccgacgcauuaagacaacugcaagcuccuagugacgauuacccccaauuuaaacaugguuuaagacauguaagaauccucaagaaagaaaaaggugauuacuugguuccaaucgcuaauagggccucaggagucgcauauaaagcauacagugcgggagaaaauuucuguguagaaguauuugaaaccgccggugguaaaugggauggagaagcaguaagacguuuugaugcaaacaagaaaaaugcgggaccaaaaauugcgcaugccccucaauggagggacgcgaacgaaggugcaaaauuaguaaugaggauacauaagggggacuuaaucagauuggaucaugaaggaagggcaagaauaaugguuguacaucguuuagacgcugcggcaggcagauuuaaacuagcagaucacaaugaaacaggaaauuuagauaaaagacaugcgaccaauaaugauauugauccauuuagaugguuaauggcaaguuauaacacuuuaaagaaacuggcggcggucccaguacguguagaugaacuagguagaguauggcgaguaaugccaaauuga

SEQ ID NO: 5183 - RNA, 3507 nt, Artificial Sequence
  Cas9 variant
auggcaagaccagcauucagagcaccaagaagagagcauguuaauggauggacacccgauccacaccguauaaguaaacccuucuuuauuuugguauccuggcaccuuuuauccagaguaguaauagauucauccagugggugcuuuccgggaacaaguagggaucauacugacaaauuugccgagugggaaugugcggugcaaccuuaucgauuaaguuuugacuuaggcacaaauucaauaggcuggggauuacuuaauuuagacagacaaggcaaaccgagagaaauaagagcacuagguucuagaauauuuagugaugguagggacccccaagauaaagcaaguuuggcuguggcacgucgacuagcacgacaaaugagaagaagaagagacagauauuuaacgcgaagaacgcgauuaaugggagcauuagugagauucggauugaugcccgcugauccagcagcaagaaaaaggcuagaaguagcaguagauccguauuuagcgagagagagagcaaccagggaaagguuagaacccuuugaaauaggcagagcacuuuuucaucuaaaucaaagacgaggauacaagccagugcgaacagcaacaaagccagaugaagaagcaggcaaaguuaaagaagccguggagcgauuggaagcagcaauagcagcggcaggagcgccaacacuaggagcgugguucgcguggcguaaaacuagaggcgaaaccuuaagggcgcgacuugcaggaaaaggaaaagaggcagcuuacccauuuuauccugcucgucguaugcuggaagccgaguuugauacacuaugggcugaacaagcuagacaucauccggaucuacuaacagcagaagccagagagauccuaagacauagaaucuuccaccaacgcccacuuaaacccccaccuguggguagauguacuuuauacccagaugauggcagagcaccaagggcacuuccuagcgcacaaagauuaaggcuuuuccaggaacuagccagucucagagucauucauuuagaucuuucugagagaccacugacaccagcggagagagacaggauuguagcauuuguacaaggacggccuccuaaagcaggaagaaaaccaggaaagguacaaaaauccgugccauuugaaaaacuaagaggacucuuagaacucccuccaggcacaggauuuaguuuggaaucagauaaaagaccugaguuacugggagacgaaacgggugcuagaauagcgccagcauuugguccuggcuggacugcgcugccacuggaggaacaagaugccuuaguagaauuauuauuaacagaagcugaaccagaaagagcgauugcugcucugacggcaaggugggcuuuagacgaggcuacagcggcaaaauuagcgggugcaacguugccggauuuccaugguagauacggaagaagggccguagccgaauuauuaccaguauuagaacgcgaaacgagaggagauccagauggacgaguuagaccuauaagauuggaugaagcaguaaaauugcucagagguggaaaagaccauucagauuucagcagagagggagcauuauuggaugcuuuaccuuauuauggagccguuuuagaaagacauguagcauuugggacagggaauccugcagauccagaagagaaacgaguagguagagucgcgaauccaacaguucauauagcauuaaaccaauugcgucauuuggugaacgcaauauuagcucgccacggacgaccagaagaaauaguaauagaacuagcccgagauuugaaaagaagugcugaagauaggcguagagaagacaaacgacaagcagauaaccagaaaagaaaugaagaaagaaaacgacuuauuuuaaguuuaggagagagaccaacaccccgcaauuuacugaaauuaagauuaugggaagaacaagggccaguagaaaaucgcagauguccguauucaggcgaaacaaucucgaugagaaugcuucugagugaacaagucgauauugaucauauuuuaccauuuaguguaucacuugacgauucagcugcaaauaaaguaguaugcuuaagagaagcuaauagaauaaagagaaauagaaguccaugggaagcauucgggcaugacagugaacgcugggcaggaauacuggcgagagcagaagcauuaccaaagaauaagagauggcgauuugccccggaugcacuagaaaaauuggaaggggagggcggccucagagcaagacaucucaaugacaccagacauuugucaagauuagccguugaauauuuacgauguguuugucccaaaguaagaguuagucccggaagauuaacagcucucuugagaagacgauggggaauagaugcaauauuagcagaagcugacgggcccccuccugaaguuccggcagaaacacuagacccgagcccugcagaaaagaauagagcagaucaccgacaccaugcacuagaugcagucgucauuggauguauagauagaucaaugguucaaagaguacaauuagcagcagcgagugcggaaagggaagcugcugcacgugaagauaauauucgacgugugcuggaaggcuuuaaagaagaaccuugggacggauuuagagcugaacuagaaagacgcgcaagaacaauagucguaagucaucgaccugaacacgggauagguggcgcauuacauaaggagacagcauaugggccaguagauccuccagaagagggauuuaauuuagugguaaggaaaccuauugauggacugaguaaagaugaaauuaacagcgucagggacccuagguuaagaagggcacuaauagaucgauuagccauaagacgacgggacgcgaaugauccagcuacagcauuagcaaaagcagcagaagaucucgcagcacaacccgcaucgagaggaauaagaagagucagaguccuaaagaaagaaucuaacccaauuagaguagaacauggagguaacccaucagguccaaggucaggcgggccguuucauaaauuacuccuggccggugaaguacaucacguagauguagcauuaagagcugacgguagaagauggguugggcauuggguuacacuauuugaagcucauggggguagaggagcagauggugcugcagcaccaccaagauuaggggauggagaaagauuuuuaaugagacuccacaaaggagauugccuaaaacuugagcauaaaggaagagugaggguaaugcaaguggugaaacuagaaccaaguucaaauucuguaguaguggucgaaccucaccaggucaaaacugauaggucuaaacauguaaaaauaaguugcgaccaacuuagggcaagaggcgcaagaagagugacgguagacccacuaggccgaguaagaguucaugcaccaggcgcuagaguaggcauagguggagaugcaggaagaacggcaauggaaccagcugaggauauaaguuga

SEQ ID NO: 5184 - RNA, 3513 nt, Artificial Sequence
  Cas9 variant
auguccaaauacaacguaggccuagauauaggaauagcaucaguaggauggucuauaguggacgcagauaaaaagaaaauaauagaucuaggaagccgaaucuuuucaagcggaaacgcagccgcuaaucaagaaagaaggggauuccgaggaacaagacggcuaauaagacgcaggaaaaacagauuaacugauguaauaaacuucuucggcgaaaagaaauucaucgacacuaaaguaguggauaaaaacggccauguacauuauaaauucuccguaaauaauacagaaucuccuuacgaacuuagaguaaaaggacugucugaaauacuaacaaaacaagaauuaguuauagcauuauaccauauaguuaaacauagaggcauuaguuacgaucuuggugacuuagaagacgacggaacaucaggaguaacagacuauaaaacgagcauaaauauuaauagacaauuauuaaaugaaaagacaguaggucaaauacaacuagaaagacuaaaugaauuuggaaaaguacguggucaaguagaagaaaacgaaaacguaacacuacuuaaugucuuuccaucagccgcauacgucaaagaagcaacacaaauauuaacaaaacaacgugaauuuuaccccgaaauaacagacgacuucaucgcuaaauucaugcuuuucaucacucgaaaaagagauuacuuuguaggaccaggaaacgagaaaagccgcaccgacuauggaauauauaagaaagauggaagaacauuagauaaucuuuuugaugaacuaauugguauagacaaaauaaauggagagaaaagagccucagcuucgucuuuaacagcgcaaauuuacaauaugcugaacgacuuaaauaaccuaacugucccaaauacagaagacggcagauuaacaauccaaaccaagaaagaaauccuagaagcagcaaaaacgacuaauggacucuuuggaauagcgcaaauauguaaaauuaucggauguaagaaagaugauauaaaagguuuuaggauagacaaaagugaaaagaaaaucaugcacacucuaucgggcuauagaaaauuucgaaaagaacuugcagacguuaacaucgaagcgaaugaccugaacauuaacuuggucaacaaaauagccgauauacuaacccucaacaccgaaaaagcggaaauacguaaacaauuagacaaaaguaacauggauauuucaaaugaaaugaaagaaauaguaauaaauaaaaacaaagaguuccugguagacgggcgagccacguggcacucauucagcuauaaaacccuaaauuuacuaauaccggaacuauuaaauacaccagaagaacagaugacgauccuaacuagacuaggguuaguaaaacccaacaauaagaaauacgaaggauugaaaaauauacccgcgagaagaauuacggaagaaauauacaacccagucgucgcuagagcaacccgagaagcaguaaacguauuuaacgcuauaacaaagaaaguagggagagauaauaucaaagacguaauaauagaacuaccacgcgaagauaacgaaguagacaucaaaaagggaauaguuaaaagacaaaaacaaaacgaaguggaaaaagaaacugcagaugcauuaguaaaacaacauaugacaauauccgauucagcacuaauagcacaauauagaaaaauacgagggcuaucucaaaaaguaagguauugguaccaacaagauacuauauguccauacugcggaaagaaaauagaagcaguacagcuuauaaacaauaacgacucguuugaaguagaccauauaguaccaauaucgguaucauucgacgacagucagaauaacaaaguguuaguacacucacaaugcaaucaagcgaaagaaaaacaaacaccacuaggauggcuaaacaacggcggcggcuucggacaaucaaaagcagauuauauagcgagagucaaaagcaacaaaaauuaugccaaaaacaaaaucgauaauuuauuaaaugaaacagaccuaaaugauauagcaacacaaagaggauuuauacaaagaaauuuaaaugacacacgauaugcaucaagaaucgucuuaaaugaguucuacucauucuuccguucaaauaaucuaagcacuaaaguaaagguaguaagaggaaaauggacuucacaaaugcggaagaaauggaauggcgucgguggucugucaaaaaccagagacacauaucaccaccaugcuauagaugcuugcauaauagcaugcuuuccauuguugaaggcuuucgacaaagcaauuaaauugauagacguagauggagaaacaggagaaaucuuacaagacaagaaagcaauuaaacucgcacaagaagcagaaaucguagagaaaauaagcgucaucaaaaauaagaaauuugaaaauaugguaaaugaaauauacaacuucccacuauucaaacagguagaacuagcaaaugauauaacaaaucucgaaaacccgguaaaauucagucaccacguagauaagaaagcaaaucgagcaguugcuaaccaaacaauauacggcacacggauaaaagaaaaagaaguaacaaaacguggaaagaaagagaaaauucaagaaagauacacacucggcacaauuaaaaauauauaugacauagauggcuucaugaacuuuaagaaacuguacgacaaaauuagcaaaaaugacgauguaaaauuucugaugcagaaaaaugacccuaaaacaugggaaaaacucauagacauauucaacucauacccugauagcgaagaaguaacucaagucgacggaaaaguaaaacgaguagcaguaagcccauucaaacuauauuacagagaaaauggauucauaacaaaauacucgaaacauaaugauggcccaaaaguagucucaauaaaauauuacgauucaaaaguaggaagccauauagacauuacccccaaagaugcaagaaacaaaguaauacuacaaaguuuaaaaccguggagaacugacguauauuuuaacaguauaacacaacaauaugaacuucuuggucuuaaauauagcgacuuaaaauuuacgaauggaguauaugguauaacacgagaugccuacgaaaaacuaaaacacggagucuccgaagacggaguaacugcauggaaaccuauaucgaaaaauagugaauuuagauuuaguuuauaccgcaaugaucgaguacgaguaauagaugaaaaaggugacucaaucgaacucuuauuugcaucacgaacuacauccaaugaaggauaugucgaauuaaaaccaauauacaaagcgaaauuugauucaaaagaagaaguaggauuuuacggauuaguaagcaauggaagauuaaucaagaaaaugucgaaaggaggauacaaauuauacaaagugaauacagauaucuuaggcaaaccauauuacgucacccgagaaagcgaugaaccaaaacuaucacucuga

SEQ ID NO: 5185 - RNA, 3516 nt, Artificial Sequence
  Cas9 variant
auggcaaaguacagcgucggacuagauauagguauaucaagcguagguugggcaaucauagauauagaaacaaaacaaauaguaaaccuugggaguagaauauucccuucaggaaacgcagcaggcaaccaagaaagaagaggauuccgcggaaucaggagacuaauacgaaggagaaaaaauagacuaacagaucuaaaaaaacuccuuggagaaacauucuucucagacuuaaaaaagauagauagcaaugguuaugaauacuacgacauagacuuucaaauaaaugcaaacccauacgaacuacgcguaaaaggaauaacagaaaaauuaucaaaaaaagaauuagcagucguacugcaucacauaauaaaacacagagguauaucauacgacuuaggcgaucuagaagaugacgguacaucagguguuucagacuauaaaaacucaauuaacauaaaucgccaacuacuacgagaaaaaaccguaggacagauacaacuagaaagauuaaucgaauuuaaccagguacauggucaagucaaaaaagcugaggacgugucucuauugaacguauuuccgaguucagcauauagagacgaggcaaacaaaauuaugauaaaacaacaagaauuuuauuccgaaauaaccaacucuuuuauggaacaaguggaccaacuaguaucaagaaaaagagacuauuuuauaggaccaggaaacgaaaaaagcagaaccgacuauggaauauacaaaagcgacggucgaacacuugauaaucucuuugcagaauuaauaggaacagacaaaauaaacggagaaaaaagagcgagcgcaucuagucuaacagcccaaguauacaacuuauuaaacgaccuuaauaaccuacacguuucaaacacugaagauggcaaauuaacaacaagcaccaaaaaagaaauaauaaaagcagcgaaaacaacugacggcguguuuggaauaagccaaauaugcaaaauaauaggaugcaaaaaagaagagauuaccggguucagacaagauaaaucggaaaaaaaaguaauacacacacuagcagguuacagaaaaauaagaaaagcacuagcaaccauaaauaucgaagcaaaugaacugaaucccaccguauucgaccaaauugcagacauuuuaacccuaaauacggagaaagccgaaauuagaaaacaacuagauaaaguccaacuugacauaacagaugagaugaaagaacuagucauugauaaaaacaaagacuuucucguggauggaagagcaacauggcauagcuuuagcuaucaaacuuuaaacaugcuaauaccagaguugcuaaacacaucagaagaacaaaugaccauucugacaagaauggggcuaaugaagagcgacaaugaaaaauaccgugggcuaaaaaaaauaccagcggaaaaaauagccagcgaaauauucaauccaguaguugcaaaaucaaccagagaagcaaucaaaguauucaaugcaauaaguaaagaaauaggcaaaaauaacauagagcacguuguuauagaauuaccgagagacgauaaugaagaagaugaaaaaagaaaaauucaaaaauuacaaaaagcaaaugagacagaaaaagaagccgcagacaaccucguaaaacauaaguuaggaauaucagacucggcucuaauagcucacuauagaaaauucaaaggauuaucacaaaaaguacgauauugguaccaacaagaaacauauugcccauacugcggcaaaauaauagaagcaacacaacucauaaacaacaaugauaauuucgaaguagaucacaucauaccgauaaguguuagcuacgacgacucgcaaaauaacaaagugcuaguacauagccaaugcaaccaagccaaagaaaagcagacaccacuaggcuggaucaacaauggaggagguuucggacaaagcaaaaaugaauacacaaauagaguaaaaaauaauaaaaaauacucuaaaaacaaaguugacaauuuauugaaugaaacagacuuaaccgacauuaucacucaacgaucauucauacaacgaaaccucaacgacacaagauaugcagccagaaccguucuagacgaguucuacucuuucuuuaagucaaacgacuuaccaacuaaaguaaaagucguccguggaaaauggacaagccaaaugaggagaaaauggaacaauguaggcgguuuaagaaaaacaagggauacacaccaccaccacgccauagacgcaagcauaauagcaucauucccacuguuaagagcauuugacagagccauaaaacucaucgacguugacaaagaaacuggagaaauagugcaauauggcaaagcaagcuuaaacggagaugucaucgaagaaaaaucagugauccaagcaccaaucauuaaaaaugaaaaauuugaaaaacugguagaugaaaucuauaacuucccacuauucaaacaaguagaauuagccaauaacauagaaaacccagaaaaucccgucaaauucucacaccauguugauaaaaaagcuaaccgaacaguagcgaaccaaacaauauacuccacaagaauaaaaaaaacagaaaaaauaguaagaaagaaaguaacagcaaaagaagaagaauacguuaucggaacaauaaaagacauuuaugacgugacaaauuuugaaaaauucaaaaaacuuuaugaugaaucauccaaaaaagaugacauaaaauucuugaugcaaaaaaacgauccgaaaacaugggaaaaauuaguugaaauaaugaacacuuauccagauuacgaagaaauuucccaacuagacgguaaagugaagagagucaagguaaguccuuuuaaacuauauuuccgggaaaaugguuucauaacaaaauaugcaaaacauaacaacgggccaaaggugguaaguauuaaguacuaugacucaaagcuaggcaaccacauagauauaacaccugucaaugcaaacaauaaaguaauauuacaaucucuaaaaccauggagaacugacguauacuauaacaacgaaacucaacaauacgaacuccuaggacuaaaauacucggaccuaaaauuuacaaaagguguuuacggaauuacaagagaagcauaugaaaaauuaaaauacggcuacacagacggcguaccggcauggaaaccuauaucuaaagaguccgaauuuaaauuuucacuauaucgaaaugaucggguaagaauaaucaaugaagccggagaaaaaaucgaccuucuauucggcucuagaaaugaaacgagcgaagguuacguugagaugaaaccaauauucaaaacaaauuuugacgaugcugaagaagcaaguuuuuacgguaaaacuaguaacaaaagacuaauaaaaaaaauggcgaggaaaggcuaccaaaucuauaaaguaaauacagauauauuaggaaaucuguacuacacagcaaaagaaucaaacgaaccaaaauuagacuuauga

SEQ ID NO: 5186 - RNA, 3519 nt, Artificial Sequence
  Cas9 variant
augagaaaacccuacucaauaggcuuggacauuggaacaaauuccgucggaugggcaguaauaacagacgacuacaaaguccccucaaagaaaaugagaauacaaggaacaacagaucgcacgagcauaaagaaaaauuuaauaggggcauuacuauucgauaacggggaaacagcagaagcuacacgauuaaaaagaacaacacgaagacgauacacaagaaggaaauauagaauuaaagaauuacagaaaauauuuucaucugaaaugaacgaacucgauaucgcauucuuucccagacuaucagaauccuuuuuaguauccgaugacaaagaguuugaaaaucacccaauauucggaaacuuaaaagaugaaaucacauaucauaaugauuacccaaccauauaccacuuacgacaaacacuagcagacagcgaccaaaaagcggaucuaagauuaauuuaccuagcacuagcacacauaauaaaauucagaggucacuuuuuaaucgaaggcaaucuugacagcgaaaacacagauguacauguacuauucuuaaacuuagucaacauauauaacaaucuauuugaagaagacauaguagaaacggcaaguaucgacgcagagaaaauauuaaccucaaaaacuuccaaaucaagacggcuagaaaaucucauagcagaaaucccaaaccagaaaagaaacaugcuguucggaaaccucgucucauuagcauuagguuuaacaccaaacuucaaaaccaacuuugaacuccucgaagaugcaaaauuacaaauaucaaaagacaguuacgaagaagaccuugauaacuuacucgcgcaaauaggagaucaauacgcagaucuguucauugcugccaagaaacucucggacgcaauacuacuuucagacauuauaacaguaaaaggcgcaucuacaaaagcaccacuaagugcaucaaugguccaaagauacgaagaacaccaacaagaccuagcauuacugaaaaacuuaguaaagaaacaaauacccgaaaaauacaaagaaaucuuugauaacaaagagaaaaauggcuacgccggguauaucgauggaaaaacaucacaagaagaguucuacaaauauauaaaaccaauuuuauugaaauuagacggaacagaaaaacucauaucaaaauuagaaagggaagauuuccucagaaaacaacgcaccuucgacaauggaucuaucccccaccaaauacauuuaaacgaacuaaaagcaauaauaagacgucaagaaaaauuuuacccauuuuuaaaagaaaaccaaaagaaaaucgaaaaacucuuuacauucaaaauuccuuacuacguaggaccacuagcgaacggucagagcucauucgcauggcuaaaaagacaaucaaacgaaaguauuacaccuuggaacuucgaagaaguaguagaccaagaagcaagugcgagggcauucauugaaagaaugacuaauuucgauacauaccucccugaagaaaaaguacuaccuaaacauagcccacuuuacgaaauguucaugguauacaacgaauuaacaaaaguaaaauaccaaacagaagguaugaaaagaccgguauuccucagcucugaagauaaagaagaaauaguaaauuuauuauuuaagaaagaaagaaaaguuacugucaaacaacuaaaagaagaauauuucaguaaaaugaaaugcuuucacacaguaaccauuuuaggaguagaagacagauuuaaugccagcuuagguacauaucacgaucuccucaaaauauucaaagacaaagcauuccuagacgacgaggcaaaccaagacauacuugaagaaauaguguggacacuuacuuuauuugaagaccaagcaaugaucgaacgaagauuaguaaaauaugcagaugucuucgaaaaaucaguucuaaagaaacuuaagaaaagacacuacacaggauggggacgacuaagccaaaaacugauuaacgguauaaaagacaaacaaacaggaaaaacaauccuaggauucuugaaagaugauggaguagcaaauaggaacuuuaugcagcuaauaaacgauagcucguuagacuucgcaaaaauuaucaaaaacgaacaagagaaaacaaucaaaaaugaaagccuagaagaaaccauagcaaaccuagcagguuccccagccaucaagaaaggcauacuccaaagcaucaaaaucguagacgaaaucguaaaaaucauggggcaaaauccagauaacauuguaauagaaauggcaagagaaaaucaaucaacaaugcaagggaucaaaaacucuagacaaagguuaagaaaacuagaagaaguacacaaaaauacuggaucaaaaauauuaaaagaauauaacguaucaaauacacaacuacaaagcgacaggcuauaucuauaucuucuccaagauggaaaagauauguauacaggaaaagaacuugauuaugauaaccuaucacaauacgauauagaucauauaauaccacaaucauucauaaaagacaacuccaucgauaacacaguacuuaccacccaagcgucaaaccgaggaaaaagcgacaaugugccaaauauagaaacuguaaacaaaaugaaaucauuuugguauaaacaacuaaaauccggcgcaaucucacaaaggaaauuugaccaucuaacuaaagcugaaagaggagcacuaucugauuucgauaaagccggauuuauuaaacgacaguuaguagaaacuagacaaaucacaaaacacguagcacaaauacuugacagcagauuuaauaguaauuuaaccgaagauagcaaaucaaacagaaacguaaaaauaauaacucuaaaaagcaaaaugguuagcgacuucagaaaagacuuugguuuuuauaaauuacgugaagucaacgacuaccaucacgcacaagacgcauauuuaaaugcuguugucggaacggccuuauuaaagaaauacccuaaauuagaggccgaguucguauauggagacuauaaacauuaugauuuagcaaaauuaaugauucaacccgacucuagccuaggcaaagccaccaccagaauguucuuuuacaguaaccuaaugaacuucuuuaagaaagaaauuaaacuugcagaugauacaauuuucacacguccacaaauagaaguaaauacagaaacaggagaaauaguaugggacaaaguaaaagauaugcaaacaauucguaaaguuaugaguuacccacagguaaauauagucaugaaaaccgaaguacaaacaggaggguuuaguaaagaaucaauauggccaaaaggcgacucagauaaacuaaucgcaaggaaaaagagcugggacccaaagaaauauggugguuucgauaguccaauuaucgcuuauuccguacugguuguagcgaaaaacugcaaaaggaaaaauagcaaaacuaaaaauuaucagcgaacauguggaaacaaaaacaauggcacaagauga

SEQ ID NO: 5187 - RNA, 3522 nt, Artificial Sequence
  Cas9 variant
augcgaccaauagaaccauggauucuuggccuugacauagguaccgacuccuuagggugggcaguauucucaugcgaagaaaaagggccuccuacugcaaaagaacuuuuaggaggaggaguacgauuguucgauaguggaagggacgcaaaagaccacacaagccgacaagcugaaagaggggccuuucggagagcuagacgucaaacacgaacuuggccuuggagaagggauagacuaauagcucuguuccaggcagcgggcuuaacaccaccagcagcagaaacaaggcagauagccuuggcucuaagaagagaagcaguaucgagaccauuggcaccagacgcuuuaugggccgcguugcuacaucuugcacaccacagaggauucaggucaaacaggauugacaaacgagaacgagcagcugcuaaagcacuagcaaaagcaaaaccggcaaaagccacagcgaaagcaacugcaccggcaaaagaagcagacgacgaagcagguuuuugggaaggggcggaagcugcauuacgccaaagaauggcagcuucaggugcaccuacagugggagcacuauuagcugaugaucuugauagagggcagccaguucgaaugcguuauaaucaauccgauagagaugguguuguugcaccgacuagggcucuaaucgcagaagaacuugcagaaauuguagcuagacaaucaagugcauauccuggucucgauuggccugcugucaccagauuggugcucgaccaaagaccauuaagaaguaaaggagcagggccaugugcauuuuuaccgggagaggaccgcgcucuuagagccuugccgacaguacaagauuuuauuauucgucaaacucuagcaaauuuaagauuaccuagcaccagcgccgaugaaccuagaccacuuacagaugaagaacaugcgaaagcucuagccuuauuaucgacagcccguuuuguugaauggccagcccuacgcagagcuuuaggguuaaaaagaggcguaaaauucacagcugaaacugaaagaaacggcgccaagcaagcggcuagagggaccgccggcaaccuaacagaagcaauacuagcaccauuaauuccaggauggucaggaugggacuuagacagaaaagauagaguuuucucugauuuaugggcagcaagacaagacagaagugcacuacuagcauuaauuggugauccaaggggaccaaccagaguuacagaagacgaaacagcagaagcaguggcagaugcaauacagauagucuugccuacgggucgagcaucgcuauccgcgaaagccgcgagagcaauagcacaagcaauggcuccagguauaggauaugaugaagccguaacuuuggccuuaggacuacaucacucucauaggccacgacaggaacgacuagcacgauugccauauuacgcugcagccuuaccggacguuggcuuagacggagauccaguuggacccccaccagcugaggacgauggagcagcggcagaagcauacuaugguagaauugguaacauaucaguucauaucgcucuaaacgaaacuagaaaaauaguaaacgcguuacuacacagacacggaccuauacuaagauuaguaaugguagaaacaacaagagaauuaaaagcuggugcggaugaaagaaaaagaaugaucgcagaacaagcggaaagagaaagagaaaacgcagaaauagauguugaacuacguaaaucagaucguuggauggcaaaugcccgugaaagaagacaaaggguuagauuagcaagaagacaaaacaaucucugucccuacacauccacuccaauaggacaugcggaccuucuuggagacgcauaugacauagaucauguuauuccguuggcaagaggaggacgagacagucuagauaauaugguacuaugccaaucagacgcgaacaaaacuaaaggugauaaaacuccaugggaggcauuccacgauaaacccgguuggauagcacaacgagaugacuuuuuagcuaggcuagauccucaaacggcaaaagcacucgccuggagauucgcugaugacgcaggcgaaaggguagcacgcaaaucagcugaagacgaggaucaaggauucuuaccuagacaauuaacugacacaggguauaucgcgcgaguggcauuacgauaccucucguuaguuacuaacgaacccaacgcaguggucgcaaccaacggccgucuuacgggcuuauuaagacuggcaugggacaucacaccggguccagcuccaagagaucuucuaccaacgccucgcgacgccuuaagagacgauacugccgcaaggagauuucuagacggauuaacaccacccccauuagcaaaagcaguagaaggcgcaguacaagcucgacuugcagcauuaggaagaagucgaguugcugacgcaggacuagcugaugcacuuggucuaacccuugccucauuaggaggaggugguaaaaaucgagcagaccaucgacaccauuuuauugaugccgcaaugauagcugugacaacuaggggauugauuaaucaaauaaaucaggcaaguggagcaggacgaauuuuggauuuaagaaaauggccaagaacuaacuuugaaccacccuauccaacguuuagagcugaagucaugaaacaaugggaucauauucauccaucuauucgccccgcucacagggaugguggguccuuacaugcagcaacuguauuuggagugagaaauagacccgacgcaagaguauuaguccaaaggaaaccagucgaaaaauuauuucuugaugcuaaugcaaaaccuuuaccagcugauaaaauagcggaaaucauugauggauuugcaucaccaagaauggcgaaaagauucaaagcacucuuagcucgauaucaagccgcgcauccugaaguuccuccagcccuggcagcauuggcuguagccagagacccugcauuugggccgagagguaugacagcgaacacuguaauagcgggaagaucugacggagacggagaagacgcaggauuaauaacaccauuuagagcgaauccaaaagccgcagugaggacaaugggaaacgccguauaugaagucugggaaauacaaguaaaaggacguccuagauggacacacagaguuuuaacgagauuugauaggacacaaccagcaccaccuccuccuccggaaaacgcuagauuaguuaugagauuaagaagaggagauuugguauauuggccauuggaaucaggagacagacuauucuuaguaaagaaaauggcaguagaugggcgacuagcauuauggcccgcaagauuagcaacaggaaaagcuacugcacucuacgcacaacucucauguccgaauauaaaccucaauggugaccaagguuacuguguacaaagugcagaaggaauuagaaaagagaaaauuagaacuaccucuugcacugcauuaggaagauuaagacuaucuaagaaagcaacauga

SEQ ID NO: 5188 - RNA, 3525 nt, Artificial Sequence
  Cas9 variant
augggaaaguauucgauuggacuugacauagguauaaguucuguaggaugguccauaauugacaucgaaaaaaagaaaauaguagacuuaggaagcagaauuuuucccucgggaaaugccgcagccaaucaagaucgcagaggcuauagaggcacaagacgacuaauuagacgucgcaaaaaccgacucgcagacguaauaaacuuccucggcgaagaaaacuucauagacacaaaaguuguggaccagaaugggaacauacauuauaaacuacuaguaaacucuacagaaucaccauauaaacuaagaguuaaaggccuaaguaaaaugcuaacaaaacaagaauuaguaauagcacucuaucacauagucaaacacagagggauaagcuaugauuuaggagaccuagaagaugauggaacuucaggagucacagacuacaaaacaagcauaaacauaaaccgacaauuacuaauaaaaaagacaguuggacaaauacaacuugagagauuaaaggaauucgguaaagugcgaggccacguaaaaaaggacgaaaacaucacccuacucaauguauucccuucaucagcuuauguuaaagaagccacacaaauacugacuaaacaaagagaauucuaccccgaaauaaccgacgauuuuauaacgaaauuuauaccuuucauaucaagaaaaagagauuauuucguggguccaggcaacgaaaaaagccguacagauuaugggauauacaagaaagauggcagaacacuagacaaccuauucgaugaacucauagguauagauaaaaucucuggagaaaaaagagcuucugcaucuucagugacagcccaaauauauaauauguuaaaugaccuaaauaaccuaacagugacaaacacagaagacggcaaacuaacaacacaaacaaaacgugaaaucauugaagcagacaaaacuacuaacggacuuuuuggaauaacacagaucugcaaaauaaucggauguaaaaaggacgacauaaaaggauucagaauagauaaaguagaaaagccaauaaugcacacacuaagcggauauagacgauucagaaaggaauuagcaaaaauaaacaucgaagcuaacgacuuagauaucaauuuaguuaacaagaucgcugacauacuaaccuuaaacaccgaaaaagccgaaauacguaaacaacuaaacaaaagcaauaucgaugucuccaaugaaaucaaagaacuuauaauuaacaagaacaaggauuuccuagucgauggacgagcuacuuggcauaguuucagcuauaaaacacuuaaccuacuuauaccagaguugaugaacacaagugaagaacaaauaaccauccuaacaagacuaggauuaguuaaaucuaacucugaaaaauacaaaggcuuaaaaaauaucccagccaggaggauaacugaaggcauuuauaauccuguaguugcaaaagcuacacgcgaagcuguaaauguauucaaugcaauagcaaaaaaaaucggacgagauaacaucucagauguuguaaucgaguuaccacgagaagacaaugaagcagacauaaaaaaagguauaguaaaaagacaaaaacaaaacgaauuagaaaaagaagcagcggacgcucuaguuaaacaacagaugaccauaucagacagugcgcuaguagcacacuauagaaaaguucgcgggcugucacaaaaaguaagauauugguaccaacaagguaccuguugcccauacugcggcaaaaauauagaagcgguccaauuaauaaacaacaaugauucauucgaaguagaccacauuauaccaauuucaguaaguuucgacgacagucaaaacaacaaaguacuaguucacucacaguguaaccaagccaaagguaagcagacaccacuaggauggcucaauaaugguggaggauucggacagaauaaaacagaguacgucgcaaaaguaaaaacaaacaaaaacuacaguaaaaauaagauggauaacuuacucaacgacauggaucuaucugauauaguuacacaaagaggguucauucaacggaaucuaaacgauaccagauacgcaagucggauaguauuagaugaauuuuacucauucuuuaaaucaaauaaccuaucaacaaaagucaaaauaguaagggguaaauggacuucacaaaugagaaaaaaauggaacggaguaggcggacuaaaaaaaaccagagauacguaccaucaccaugcaauugacgcauccauaaucgcaaguuuuccacuacuaaaggucuuugauaaagcuauaaaauuaauagauauagacagagaaacaggagaaauacuacaagacaaagaagcaauuaaaaugucgcaagaagcgaaguuauuagaaaaaauaccuguaauacaaaaugaaaaauuugaagaacuaauaaacgaauuauacgacuuuccacuuuucaaacaaguagaauuagccaacgauauaaccaaccccgaaaaccccgugaaauucagccaucacgucgauaaaaaagccaacagaagcguagcgaaccaaacaaucuauggcacgagaauaaaagaaaaagaaauaaauaaacgaggaaaaguagagaaaguacaggaacguuauauauuagguacaauaaaaaacauauaugacauagacagcuuuaccucauucaaaaaaauauacgacaagaugaguaaaacgggagauguaaaauuucuaaugcaaaaaaaagacccaaaaaccuggggaaaacucguagaaauacuaaauaguuauccugacagcgaagaaauaacacaaguagauggaaaaguaaagcgcguuaagguaagccccuuugaacuuuaucgucgagaaaaugacuuuaucacaaaauaugcaaaacacaaugacggaccaaaaauaguaucaauaaaauauuacgacagcaaaauaggaucgcacauugauauaacacccaucaaugcuaaaaauaaaguaguucugcaaagccuaaagccauggagaacagacguuuacuucaacucagaaaccagacaguacgaacuauuaggguuaaaauauuccgauuuaaaauuuacaaacgggguuuauggcauaaccagcgaagcuuacgaaaaauuaaaacauggcauaagugaagacggaaccaaaacauggaaaccaauuggaaaaaauaguggauucagauuuucucuauacaggaauaacagaguaaagaucguagaugaaaaaggagaaucauuagagcucuuguuugcaagucggaccaccagcaacgaaggauauguagaacuaaaacccaucuacaaaucuaaauuugacaguaaagaagacgugggauuuuacgggcaaaugacacccaguggacaauucgucaaaaaaauggccagagugggguauaaacuuuacaaagucaacaccgauguguuagguaacccauauuacauaacaaaagaauccgaugaucccgaacuaaguuuauacaagaaauga

SEQ ID NO: 5189 - RNA, 3528 nt, Artificial Sequence
  Cas9 variant
auggaagaaaugaaacaaacaggcaggaaaaaugaagcccccaaauuaacagaucuaaauuauagaauugggcuagauauaggaauagcaagcguuggaugggcaguucuagaaaacaauagccaugacgaaccauucagaauaaucgauuuaggaguaagaauuuuugauacagcugaacagccaaagacaggugcaagucuagcauuaccuagaagagaagcuagaucagcacgaaggagaauacgaagacggagggauagaaucgaacguauaaagaaacuauuucaagcagaaggauugauuaacauagacgaguucgaagcuagauacaaaauugcagguuugucagacguguauaaauuaagauaugaagggcuagacagaaaacucacagacgacgaauuagcacaaguuuuauuacauauagcaaaacauagagguuuuaaaucaacaaguaaagcagaagaagcggaaaacgaaaaugacgcugcgaaaaagaaagaagcaggagcuuuaaagaaagggaucuccaacaauaagaaauuaauggaagaaaaaggguacaggacugucggagaaaugauguaccuggaugaaaacuuucgaacagacuguccauggaaugaaaauggauauauucuuacaccucguaacaaaucaggugauuacaaacauaccguacuaagagauauguuaguggacgaaguaagagaaauauucaaaagccaaagaucgcuagguaauauacaugccucagaagaacuagaaaaugccuaucuugacauaaugcuaucacagagaaguuuugacauggggccaggugcgccaagcaaauaugcaauggaagguuucgaggacaggguugggcuauguacauuugaagguaaaaauggugaaaaacgcgcagcuaaagcagcauauacgagugaauuauuuguagcucucgagaaaaucaaucauacgaaaaucgugagugaugauggagcaacgagguuucuaacaacuuaugaaagaaaaucaauaauagaauuaaugcacaaacaacaaacagugaaauacgcagcgguaagaaaagcaaucggauuagcagaagaagacaaauuuuauaacuuaaacuacuccccaaaagcaggauccaagaaaucgccggaagauaccgacuucguaaaauuggaaaacuaccauaaaauuagaaaagcauuaggugaagacauaguaucugaacacuuaccagcugagaaaauaaaacuguaugauagcauagcgacuauauuaacauuauucaaaaacgacgacucaagaauaaaaagguuuauagaauuaggcauaggcgaggaauguuucgauggacucuuaaguuuguccccuagcaaauuccauaacuuaucauuaguggccaugggaaaaaucauaccauucuuauuagacggaaacacguaugauaaagcaugugaacuagcaggauaugacuuuaaagcggauaacaaaggcgaaaaaucgguacuucugaaaggaaagaacaucacagacaugguaaaugauauaacaaauccuguaguacgaagaucugucagccaaacaauaaaaguaauaaaugcgauaauacuggaauauggaagcccgcaagcagugaacauagaauuggcaagagagaugaguaaaaauuuugacgaaagaagaaaguuaaaauccgauauggagagcagagagaaggaaaauaauaacguaauaaaaagagugaaagaauacaaacuaaauccuaccggucaggauauuguaaaauucaggcuaugggaagaacaagauaggaggugccuauacucgggcgagaaaaucgauauuaaugacuuauuuucuagagaugguggauaugacguagaucauauucuaccauauagcauaacguucgacgacacauacaggaauaaaguauuaguaaaagcuagugaaaaucgacaaaaagguaaccgaacaccauaugaauacuucauggcugaaaaggaugacgacgaguggaacguauacgagacucuagugagaaacacaguuaaggauuauaagaaagucuuaaaacuccucaagaaacauauuacagaagaugagaaaucagaauuucgagaacgaaaccuuacagacacaaaauacaucacacgaaucauuuacaauaugauacgacaaaaucuaguucucaaaccauaucuuaguuuagaaaaagaaagaaagaaacaagugauggcaguuaacggaaguauaacacauuaucuaaguaaacgaugggguuuagaaucaaaagauagaaggaccgauacacaucaugcacaagaugcuguaguaaucgccuguacuaccgacggaaugauuaacaaaaucagcagauauaguaaagguagagaguuacuauauaguagaggauuuaaauuugucgaugaagaaacaggagaaauacugucccgugacaauuuuacaagagaggaaugggaugagaaauacggaguaaaaauuccaauacccugggaacauuucagggaugaauuggauauacgaaugaguagauacaacgguacaggagacgauucuauagacaaaacaacaccaagagacuucauuuuaagccacagagacgcacauaaauggauaaauuauccagaauggauguucguugaaggcagaccuggaaggaggggaguuuuagauggaauauucguaagucgcaugccaaaacacaaagucaguggacaagcccaugaagaaacgguaagaagcgcuaaauauuauaaugacggagggucaguauuugagaguggaggguauguaguaacaaagaaaagcauucaagauauaaaacuaaaagacggagaaauaaaagaguucuuuaauccagauagugacagacuauuguacaaugcuuuaguagacagacuaaauaaauuugaaaacgauccaaagaaagcauuugccgaaccauuuuauaaaccuaaagcagacggcacacaaggaccaaucguaaagaaaauaaaaguauuugaaaaacaaagcucaggaguguucguaagagacggcaaaggaaucgcugcgaauggagcaaugguaagaaucgacguauucugcgaagaagauaaagguaaaaagaaauauuauuuuguuccaauauauacggcagacgucgucaaaaagaaauuaccagauagagcagcuacagcuaauaaauuaauaagugaauggagaguaaugaaagaagaaaacuuuauauuuucauuauauagccgagacuuaauauacauagaaagugacaaaggaguccaaguuaaagacauagauggaaaaauuagcaaacccgugaaucuauucgcauauuaccuaggggcagacacuucaacggcgucaauaagcggaaaacuacaugacagcucggcgaacuucaggucaauaggcauacaaggauuaaggcgauuugauaaaugucaaguagauguauuaggaaauauaucauuuguuaauaaagagaaaagaaugccauucaauuga

SEQ ID NO: 5190 - RNA, 3531 nt, Artificial Sequence
  Cas9 variant
augaacaaaguucaggaagacugcuauaaaaaaauaaaagaaaaacuagcggauagagaauaccgcauaggacucgacuuaggaguaggcucuauuggauaugcaguaguaucacuuaaaggugacaugccagaagacgugauauuagcaggaaguagaauuuucaaaucaucgauuggcgcagcggaacgcagacacuuucgagcacaaaggaauacucaucgccaccauagagaaagaaugagauacuuauggaaacuacuugcggaaaaaaaccuugcccuacaacuaccagaaaacuuaaguaaaaaagagaauuuuacagauuuugauaccucacgaaaacguuuccccauagaaguauuaagaaaugauccuuacauauuaagauauaaagcacuagacgagaaacucucacuauuccaacuuggauacgcucuauaccauauagcgaaccaccgcggaaccgccaguguaagaaguuuccuagaagacgacgaagcgaaaguuaaagaaaacaaggaaacagcaaaacuagcaaaaaacacaaaaaaaauaauguacgaaaaaaaguaucggacauucggagaauaccuauacagagaaagaaucgaaaaauuucgacagaaugaacguaugaaggucacaaacaaaaaugaaaacaaagaauuugcaguaacccgugauaucauagaaaaagaaguagaaaugauauuaggagcacaaaaacgcuacaacacagccguucuagcagacgauuauauugaacgaauaaaaaaagcaauauuuuacgaaacggaaaaauugauaccagaacccgaauacugcccuuacuucaaagaugauaaaagacuaccuagaucacacaaacucaacgaauauagacgcaucuacgaagcacuaaacaauacaagauacuauaucccggaaauagaagaaaaaacaggggaaauacuaagcagaaaagaaaaagaacaauuaagcaaggaagaaaaagaaaaacuauuuaacuuccuuuuaaaaaacaaagagcuaaccgaagccaaagucaaaaaauuacucaaccucucagaaauggcaaaaguucaacuucagggaagagacaaaaagaaccaaaaaauaaaaggcuacgcauuaauaacacuagagucauuaccauucugguccaaauuacccgaacaacagcaagaugaguucuuauacgacuggaacaaacuuccugacgaaaaacuuaaagaucgauuacgaaacuauuacaaauuaacugacgaugaaauagaugaaacauuucaaaacauaguauuaccaucaaauuacgccccacucggaaaaaaggcaauggaaauucuucuggaauacauaaaaaacgggcucaguuacauugaagcauuagacaaagcagcugacgaaaacaaaauaaagguugaaaagcacgaaauaaaugaccuguugccauacuauggaaaaauacuccaagaaucaacacagaugcccauaggaaaagccuuuuccaaacaauucgcagccaaaaauuacaaaaaaccagauauaaauaaaaacgagcaagaauuuggaagaauagccaacccugucguacaccaaacauuaaaugaauugagaaaauuaauaaacgaaauaauaacaguauucggaaaaaaaccccuagaaauaucacuagaaacaagucgagaacugaaaaaaucucaaaaggaaagagagcuaauagcaaaacaacaagacauagacgaagaaaaaagaaaaaaaauauggaagacauauauagaaccacauuuacaacaaauaaaaaguaggucagauaaacucaaaaaauuguucguuuuugaacuuugggaagaucaaaaacauaauugcccauuuugucuagaaaaaauaaauguugaugauauauacucacgaggaguagacaaagaacaccuguuuccacuaaaaaaaagcgaagaugacagcgagaauaaucuagugauagcacacaacaaaugcaaugcgagaaaagcggaaagagcgccauucgacgcauuuggacaugaaaguauuuggaaugauauauucagcaacgcagaaaaaaacuuaccaagaaagcuauggagauucagacaaggcuccuucgaaaaguuccuugaaaaacccccuaugcucaaaagguucgaaacugacaauagcuauaucaguaagauaucagcacgauaucuagcuugucuuuuugacaaaccaagcaaaauauucugugugaagccauuccuaacagcccaacuacgaauagcauggcaacuagacgaaauaaugauuagacuagcagaaaauaucauacuagacucagaaaaagacucauucaauaaaggcggccuacaaaaaaaaaaaaggauagacaacagacaccaugcauuagacgcugugguuauagcuuaugcuagccgaggauaucauaacuucuuaaaccgaguacaugcgaaagguuacaaaauuaauuaugaugaaaaaacuuggcuaucugaaacacugagaccaccgggaaauaaaaaccucgaagacuucaaaagcggcauaaucaacguuaugauaaacgcaaacauaucaauaaaacaugaccauaauaauaaaggucagcuugucaaaagcaaagcuuacaaacucuacuauucagagauagggaaauauauaaucacaacauuaaaaucaguaucugagauauuauucaaacaaaaagaaaaaccccaagauacuuugagaagagcauuauguaaauuugaagaucguuugagugauauuaaagacaaaaaacuuaggaaaaagcucgaagauaacauuacuauuuauaaaucaauagagaaugaaucagcacucucgaaagcgaaacaagaacuagaagaauucgaccuaaaagcuaaaaaagaagguaaaaaagguuaugaaaaaauuacagauauucuaaucuauaaaaaagcaugcuccaugcacggaggcaaauacauacacgugaaaaaccgaauagagaacaaauucuuugcucuuaaagagccuacugaaauugagacaggauuuggauacgacaccgccgacaaccuaagccuagacuuauaccaugacaacaacggaaaacuauguggugaaguaauucgaaaaauagacuucaauagaaaccgcguacccaauuauaagaaagaaggauauauauuacuugaaagaauauaucaaggcgauacucuagaaguagacaucucggacgacaaaauuucacuuaaaaauaaaguaggcucagcgcccgacaaaagaaccuucguaaaaguacuaacauucaccgaaucagauagauaccuaaaaaacaagagagaccaaauacaaauauucuucugcaaccuauuaaaaucaaccuuaaaacaugacgauucuagcaaacacgacgauaguuuuuacgucucaaguaugcaaaaauacaacguuagaaaagucauacuaacaagucuaggaauaaucaaauauagaucaaaaauucuaaaaaacaaagaaauauga

SEQ ID NO: 5191 - RNA, 3531 nt, Artificial Sequence
  Cas9 variant
auguuauucccaaaaaaauuaagcaaagaagaaguagccuauguuuuaguagaaauuaacagcaauuuaaauaauaguuccaacuaucucggaaacauauccgaucgaucaaaagaauuauacuucaauaaacaaacuauaggccaauucuuauacacgaaauuaaaagaagacagacacuauaguuuaaaaaauaaaguauucuacaggcaagacuacuuagaugaauucgaacgaauaugggaaacacaagcaaucuuucauaaagaacucacagaagaccuaaaaaaacaaauacgagacacaauuauauuuuaccaacgaagauugaaaucccaaaaaggccuaauaucacuaugugaauucgaaaauaaagaaauaacaauugaaaaagaaggaaaaaccguaaccaagcaaauaggcguucgagucauacccaaaucuucuccacuauuccaagaauuuaaaaucuggcaaauuuuaaacaauguuauauguaaaaaaaaaggaaccagaaaaaaaaaagcaguaaccccagcaccccuacuauucgaacucuuuggaacucccucggaaacuuucuuuucuuuggauauggaaugcaaacaacuuuuauuugaagaauuaaaccuaaaaggaaacuugaaagcagauaaaguaauccgacuauuaggauauauaccacaggaaugggaaauaaacuacaaucaauuagaaggaaaccgaacccaaaaaucccuauaugaggcauacuuaaaaauaauagagaucgaaggauaugauauaaaaacauuuuuacguaucaaauccgacaaagaagacugggaccuagaagaaucgccuuuaagcgcaaaagaaauucgcgaaaacauacaacacauauuugaaacacuaggaauaucaaccgcaauauuauacuucgaugcaacauuaccaauaaaagacuuugagaaacaagccuccuaucaacucuggcaccuauuguacucauaugaaucagacaacuccccguccgguaaugaaacacuauauaaacucuugcaagauaaauucggauuuaagcgagaacaugccguauuucuauccaauaucucauuccaagaugauuacgguagcuuaagcgcaaaagcaauaagaaaaauauacccauacauuaaagaaaaucaauauucgacugcaugugaauuagcuggcuacagacacucaaaauuaucucucacaaaggaagaauuaaacaaccgaccauuaaaagauuuaauaucacccuuaaaaaagaauucauuacgaaacccagugguagaaaagggacuaaaucaaaugauaaacguagucaaugcccuaaucgaaaaaaacucagaaaaagacgcagaaggaaacauaaucaaauacuuccacuucgaugaaauuagaauagaacuagcaagagaacucaagaaaaaugcacaagaaagagccgaaaugacccuuaacaucaaaaacgcaacuauagaacaagaaaaaaucaaauccauccuaauaagcgacuucggcaucaaaaacccgacgaaaaacgauauaacaagauacagauuauaccaagaacucgcacacaaugauuauaaggaucucuacaccaacaccgacauuccaaaagaacucuuauuuagcaaaaauauagacauagagcauauaguuccaaaagcaagagucuucgaugacuccuucucaaacaaaacccucgcguaccgagacuucaauuuaaagaaaggagagaacacagcauuugacuucaucgauucuagucucggagaagaagaacugaaucaauauauagcaagaguagaaaacgccuuuaaaacuaaaaacauaagugcuacaaaauacagaaaucucuuaaaaaaagcaacggaaauuaacgacgguuucauuaauagagaucuaagagaaacacaauacauugcaaaaaaagcaaaagaucuacuauuucaaaucacacgaaguguagugucaaccuccggcucaauaacagaccgacuaagagaagacuggggacuuauugauauuaugaaagaguuaaacaugcccaaauacagagaccuaggauugacagaaauaaucgagagacgagauggacgcaaaguagaaguuauaaaagauuggacuaaacgaaacgaccaccggcaccacgcaauggaugcacugacaguggcuuucacaaaaccaagcuacauacaauaucuaaaucauuuaaacgcccggaaagacgaaaacaauaaauuguacgcagacauacuaggaauugaacgaaaggaaacgaccaaaauacaugacgagaauggaaacgaaaaacgaguuuucauagaaccaaucccgggcuuccgucaaauagcaaaaaaauaucuagaagaaauacuaauaagucacaaaacaaaaaauaaagucgucacaaaaucaauaaacaaaauagcggguacgaauaagaaacaagagacucuaacaccuaggggacaacuacacaaagaaacuauuuacggaaaauaccacuacuauucaaacaaagaagagaaaauagguacaaaauucgauaaagaaacaaucucaaaaguauccaacccaaucuauagauaugcacuacaaaaaagacuggaagcaaacgaaaacaacccaaaaaaggcuuuuacaggcaaaaaugcgcuaaguaaaaacccaaucuaccuagacgaugccaaaacaaaaauauuacccgaaaaaguuaaccuaauauacuuagaagaagacuucucaaucagaaaaaaaauaguaagcgaaaacccuacaucaaaagaauucguacccaacaguauaaguauagagaaaauaguggaugaaggaauaaaaagaauucuaaaggaaagacuugaaacguacaacaacgauccaaagaaagcauucgcagauuuagauaaaaaccccauuuggcuaaauaaagaaaagggaaucagcauaaaaagggucacgauaaguggaguaaaaaauacacaagcacuacauagcaaaaaagaucacuuaggaaaaccaauucuggauaaagaaggacaagaaaucccaguagauuuuguaucaaccgguaacaaucaucacguagcaauuuacagagaccaaaaaggaaaucuccaagaacagauaguuagcuucuucgaagcaguaguaagagcucagcaagggcuucccaucaucgacaaaaccuauaaacaagaagaaggauggcaauuucuauucacaaugaagcaaaacgaaauguucguauucccaaaugaaauaacuggcuuuaacccauccgaaauagauuuauuagacccuaaaaauaaaaaguuaauaaguccuaauuuauuucgaguacaaaaaauauccauuaaagacuacuucuuccgccaccaucucgaaaccaaugucgaaacaaacaacauccugaaagauauaacuuggaaacgcgguggccucucucugcuaaaaggaauuauaaaaguacggauaaaucaccuuggaaacauaguaagcauaggagaguauuga

SEQ ID NO: 5192 - RNA, 3534 nt, Artificial Sequence
  Cas9 variant
augaauaaaguccaggaaauagaauacaaaaaaauaaaagaaaaauuagcagacagagaauaucgcaucggucuggacuuaggcgucggaagcauaggauacgcaguaguauccuuaaaaaaauacgacgauuuaagcuacuuaccagaagacauaauuuuagccgguucgagaauauucgcaucaucaauaggagcgguagaacguagagaauucagacuucaacguaacucacauagacauagacgagaaaggaugagauuucuauggaaacuacuagcagaaaaacaguuagcacuacaaccaucaaaagaccucgaaaaaaaagaaaauagugcagacugugaaacaagccaaaagagauucccaauaaacauccuaaaaaacgaccccuacauacuaagguacaaagcacucgaugaaaaacuuucacucuuccaacuaggauauguauuauaccauguggcuaaccacagagguacagacagcauccguucauuucuugaagacacggacgacaaaauaaaagaaaauaccaaaaccgcaaaauuagccacugaaaccaaaaaaauaauagacucaaaaaaauaccgaaccuuuggugaauaccuauauaaagaacguauacaacaaaacgaacgaaaaaaaguaucuaacagaaaaacugcagguaacaaaaauaaagaauuugcaguaacgagagacaugauauucaaagaaacagaaaaaauccuugccagucaaaaacaauacuauacgaaugugcuuaccgacgaguauauaaaagaaaucgagggugcaauauuuuaccaaacggaaaaacucaucccagaaucggguuacugcccuuauuucaaggacgaaaagagguuacccuguagucacaaauuaaacgaauaccgaagaauauaugaagcacuaaacaacgcaagauauuccgcaccuguauuagacgaaaaaaccggggaaauuuuaagcuaucaagaaggcgaggaauuuucgagugaagaaaaaaaaauacuauucgaugagguccugcuaaaaggaaaaaaacuuacagaaagcgaaauaaaaaaauuacuucauuuaccagacggaugcgaaauccaacuacaggggagagauaaaagaacccaaaaaauaaaaggauaugcgcuuacagcccucgaagcgcucccauucuggagcaaacuaucacaacagcaacaagaugaauuccucuaugauuggaacggacuacccgaagaaaaacucaaaccaaaacuaauugacugcuacucauuaacagaaaaugaaguagacgaaacauuccaaaagauucgacuaccaucaaacuacgccccggucggcaaaaaagcgauggaaaucuuacuaacuuauaucaaagauggguacucuuauacugaagccuuggauaaagcuguaagugaaggaaaauucaaaguagauaagcaaacgacuauuuacgauucguuacccuacuaugguaaaauccuacaagaaucaacacaaaaacugauaggaaaggccuucagcaaacaauuugcaaaacgaaauuauaaaaaaccaaauacaaaccgaaacgaacgagaauucggaaaaauagcaaaucccguaguucaccaaagccuaaacgaacuacgcaaacucauaaacgaaauaauaacaguauucgguaaaaaaccacuggaaauuggccuagaaaccgcccgugaauuaaaaaaauccagcaaagauagagaaucguuagucaagcaacaaaaugaaaacgaguauaacagaaacaagauauacaaagauuacguugagccacaucuaucacaaauaaaaucccgccaagaaaacccaagccgguacauauucaaauucgaacuauucgaagaacaaaaaucaauaugcccauuuugccuaaaagaaauaacccccgacgauauaaucaauagcaaaguggacauagaacauauauucccaauagaagaauccgaagacgacgcuaaaaauaaccuaguaauagcacacaaugaaugcaacgcagauaaaggaaaaaaaaguccauuugaugcauucggggauaaaaccucagguaaauacguuuggaacgauauacuucacaaugccaaaaaaaaccugccccauaagauauggcguuucuaucaaggaucuuuagaaaaauucuuagaaaauaaaccaaugcuaaaaagauucggaaccgacaauagcuacauuucuaaaauagccgccaaauaccuagcaugucucuuuaacaauucauccaaaaucuuuugcaucaaaucaucacuaaccgcacaauuacgaaucgcaugggaauuaaacucaaucaugauaccucuagcaaaaaacauccuaagcgaaaaggaauuggaagaauuuaaaacgcucaaaaacaaaaaaaucagaauggacaaccgccaccacgcgcuagaugcaaucacaauugcauacgcaaaucgaggauaucauaauuucuuaaauaaaauacaugcaaaagguuacaaaaucgacuaucgagaaaaaaacugguuaaguaaaauucuccuuccuccacucaacagagaccucgaagacuuuaaaaucuccguaaaaaauaguauagaaaaagccaauguuagcauaaaacaugaucauaaaacuaauggaucacucgugaaaggaacugcauauaaaguuuacuauucaggaaccgguaaauauauaauuacaacacuaaaaaacgucgaagaaauaucauuuaaagaaaaagaagauccugaagacacacugaggagggcacuauguggauuugaagacuccaauauaaaagaugaaaaauuaauaaaaaagcucaaauacaacucagaccucuauaagaaaauauuaaacacaaaaccaaaagcaaaacaagaacuagaacaggcuaaccaagaaacaaaagaggaaggaaaaaaaacacaaaaaaucaccgacguacuaauauacaaaaaagccugcagccuagucggagagcaauacauccaaugugcaucaagacuugaaaacaaauuuuucgcaguaaaagaaccaacagaaauccgaaccggaauuggcuacgacaccggagacaacuuauuccuagaucuuuauuacgacaaaacaaggaaguuaugcggggagauaaucagaaaaauagauuuuaaucaaaacaaaauaccgaauuaccaaaaagaaggauacauacuauucgaaagaauauaccaaggagauacacuugaagcagacacaucagaagacaaaauauccuuaaaaaauaaaacagguuccgcacuugauaauagaaccuuuguuaaaguacuaacguuuacagagucagacaaauacuucgauggaaaaaaagauaaaauacagaucuucuucggcaaccuauuaaaaucaaacuacaaacaagacgacucauucuauauaaguaguaugcaaaaauacaauguacgaaaaguaauccuuacgagcuuagguauaauaaaauaccguucacagauacucaaaaacaaggaagucuga

SEQ ID NO: 5193 - RNA, 3540 nt, Artificial Sequence
  Cas9 variant
augagcaaaaaaguuucacgaagguaugaagaacaagcucaagaaaucugucaaagacuaggcucucgaccauauucaaucggccuagaucuaggcguagguucaauagggguagcgguggcagcauaugaucccauaaaaaaacaaccaucagaucuuguauuuguaaguagucgcauuuucauaccaucgacuggugcagcagaacgacgacaaaaacgcggacaaagaaacagccuaagacacagagcgaauagacuuaaauuccuauggaaauuacuagcagaaagaaaucuuaugcuuucuuacucagaacaagauguucccgauccagcaagauuacgcuuugaagacgcaguaguacgcgcuaaucccuacgaacuaagauuaaaaggucuaaaugagcaauuaacucucucagaauugggcuaugcauuauaucacauagcaaaucaucgcggaucaucuucaguaagaacuuuccucgaugaagaaaaaucgagugacgauaagaaauuagaagaacaacaagcuaugaccgaacaauuagccaaagagaaagguauaucaacuuuuaucgaaguuuuaacugcauucaauacaaauggauuaauaggauauagaaauagcgaaucaguaaaaucaaaagguguuccaguaccuacuagagauauaauaucaaacgaaauagauguacuacuacaaacucagaaacaauuuuaucaagaaauacuaucagacgaauauugugauagaauuguaagugcaauacuuuuugaaaaugaaaaaauaguacccgaagcugguuguuguccauacuucccagaugagaaaaaguugccucgaugucauuuccuaaaugaagaacgaaggcuaugggaagcuauuaacaacgcgagaaucaagaugccgaugcaagaaggagcugccaaaagauaucaaucagcaaguuuuucugacgaacaacgacacauacuuuuucauauagccagaucagguacagauauuacgccaaaacuaguacaaaaagaauuucccgcacuuaaaacaaguauaaucgugcuacaggguaaagaaaaggcuauacaaaaaauagcagguuuuagguuccguagguuagaagaaaagaguuuuuggaagaggcuaagugaggagcaaaaagaugauuuuuucuccgcuuggacuaauacuccagacgacaaaagauuaaguaaauaucuaaugaaacaccuucuuuuaacagaaaacgaagugguagaugcacucaaaacaguaagccuuauuggcgauuacggccccauaggcaaaacagcaacccaacuacuaaugaaacaccucgaggauggacucacuuauacugaagcacuugaaagaggaauggaaacgggugaauuccaagaauugucuguaugggaacaacaaucauugcuuccguauuauggccaaauccuaacgggaucaacacaagcauuaaugggaaaauauuggcacucagcuuucaaagaaaaaagagauucagaaggcuucuuuaaaccaaacacuaauucagacgaagaaaaauaugggagaauugcaaacccuguaguacaccagacauuaaaugaacuaagaaaacuaaugaaugagcuaaucacuauacucggcgcaaaaccacaagaaauuacgguagaguuagcacgagaacuaaaaguaggggcagagaagcgagaagauaucauaaaacaacaaacuaaacaagaaaaagaagcaguccuugcuuacagcaaauacugugaaccgaauaaucucgacaagagauauauagaaagguuucgacuacuagaagaucaagcauuugucuguccauacugucuagaacacauaagcguugcagauauagcggcagguagagcugacguugaccauaucuuuccacgggacgauacagcggauaacucauauggaaauaaaguugucgcacaucgacaauguaacgauauaaaagguaaaagaacacccuacgcagcauuuaguaacacaagugccugggguccuauaaugcacuaucuugaugaaacaccuggaauguggcgcaaaaggcgaaaauuugaaacgaaugaagaagaauacgcaaaauaucuucaaagcaaagguuuuguaagucgauucgaaagugauaauagcuacauagcuaaagcagcaaaggaauaucuaagguguuuauuuaaccccaauaaugucacagcggucggaaguuugaaagguauggaaaccucaauacuacguaaagcauggaaucuacaaggaauagaugauuuacuaggauccagacauuggaguaaagaugcagauacuagcccuacaaugagaaaaaacagagaugauaaucgacaucacggcuuagacgcgauaguagccuuauauuguuccagaucauuagugcaaaugauuaacacgaugucagaacaagggaaaagagcagucgagauagaagcuaugauuccuauuccaggauacgcaucagaaccaaaccuaagcuuugaagcucaacgcgagcuauucagaaaaaaaauacuagaauucauggaucuacacgcauuugucucgaugaaaaccgauaaugaugccaauggagcacuauuaaaagauaccguuuacucaauauuaggugccgacacucagggggaggacuuaguguuuguaguuaagaagaaaauaaaagauauugggguaaaaauaggagacuaugaagaaguagccagugcaauuaggggaagaaucaccgacaaacaaccaaaaugguauccaauggaaaugaaagauaaaauagaacagcugcagagcaaaaacgaagcugcacuacaaaaauacaaagaaagccuaguacaagcagcagcagucuuagaagaaucaaauagaaagcuaauagaaucaggaaaaaaaccuauucaauuaucagaaaaaaccauaaguaaaaaagcuuuagagcuaguaggcggauacuauuacuuaauuaguaauaacaaaagaacaaaaacauucguuguaaaagaaccuuccaaugaaguaaaaggauucgcauucgauacggguuccaacuuauguuuagauuuuuaucacgaugcccaaggaaaguuauguggagaaauaauucguaaaauacaagcaaugaaccccagcuauaaaccagcauauaugaaacaaggauacucacuauaugugagacuauaucaaggagauguaugugaauugagggcaagcgaucuaacagaagccgaaucaaaccuggccaaaacaacacauguuagauuaccaaacgcaaaaccagggaggacauuuguaauaauaaucacguucacagagaugggaucuggguaucaaauauauuuuucaaacuuagcaaagaguaagaaaggucaagauaccuccuucaccuugaccaccauuaaaaauuaugacgugagaaaaguccagcucucaucagcuggccucguuagauauguaucuccauuacuuguagauaaaauagagaaagaugaaguagcucuauguggugaauga

SEQ ID NO: 5194 - RNA, 3567 nt, Artificial Sequence
  Cas9 variant
augaaauauauauuaggauuagacaucggagucucauccguaggaauagcaguaauuuccgaagaaaaccaaaagaaaacuaucgaaaaccuagcagucagaauuguaccugaagauccggauuuccaugguaaauucuauucugguaauacagcaaguaaaaaccuugaacgcaccgcuaaaagagggaaccguaaaaacaaccaaagauucaaagccagaagagauaaauuauaccaaucauuaaaagaaaacaacauguucccaacaucaaaccuauuugaccuaucugcagucgaacuauauggauuaagagcaaaagcgguaagugaacaaguaucacuacaagaauuaggaagaauacuaauauuacuaaaucaaagaagaggauuucuaaguaaucgcaaauccguaucugaagaaaacagcacagaauacaaagaacgcauugcuggauuagaaaaagcauuaggaaauaaaacuauaggacaaaaauuauauucugaauuacaagaaaacaacaauguauucgagguauuauugcgagaaagaacauaccaaagaucaaguuauacggaagaguucgauagaauaugggaugaacagaagaaauauuaucuaaucuuaacaggaagcucaaacgaagaugacaauaaaggaacucuuuaugaucuaauucgaaauaggauaauauacuaccaaagaccauuaaaaucacaaaaaggacugauuagcgaaugucuauucgaaaaacaccacaaagccguagcaaaaagcagcccuuacuucgaacuauuucgaauauggcagaaaaucaacgaucuauccuggaaaacaccaaacggagaacuauucaaaccaacagacgaacaaaaacaaaaacucaaaaaugcccuauggaauggugacaauuuaaaucccaaacauaaauuaaccgucucuaaaaucaaagagauucuaggguacacaucaagagagaaaauuuacuuaaauuuuacagaacuagacgguucucguacauacucaauccuaagaaacgcccuaaucgaggcuggcauagaaaaaccagaacaauaucucuucuuuaacauggaaacaaaugacgaaaaagggggccucuucgaacucuggcauauaacuuauucacuaccaauagaaaaagaaguaauaaaugcacuuaaaaauagauuuggauuugacaagaaacaagcagaaauaauagcaagacgcguagguuacaguagcgauuacggcagccuauccacaagagcaauaagaaaauuauugguccauuuagaaaaaggacucggauacaccgacgcaugcgauaacaucggcuacgaucauucaggauacaaaacaaaaauugaucuacaacccaaacuuaaacaacuaaaacgaaacgagcuuagaaauccagucguagagcaaauacuaaaccaaguaguaaacgccguaaacuuaauaauagaaaaauauggaaaaauagacgaaauacgcguagaauuagccagagaacucaggaacaacgcaaaaacacggaaaaacaucucacugcuuaacagcaaaaauaagaaaaacaacgacauaauaaggaagaaauuacaagaagaauauggauuuaaauucguaaauggaagagacguuacaagauauauacuaugggaagaaaacucgaaagaauguuuauacugcaacaaaacaauaaacggaucagacauguuaacggguaaugccgacauagaacauauacugcccaaaucaagaaguuucaauaaugcuaugaacaauuacaucauaacucauagaaagugcaauucagacaagggacagaaaaccgcguacgacuuuaugagcucaaaaggcgaaguuauauugcaacaauacauagagaaaguaaacgaccuauacaaagauggcaaagggucaauaagcaaaacaaaauuugaaaaucuacuaugcaaaggcgaagacauuccuucagacuucguagaaagaaugaagaaagauucgcaauauauagcaaaagaagcagucaaaauguugaaaacaguuuguccuaauguauacaccacgacgggacaaguaacggauuuccucagagaagaauggaaauugaaaaaccuacuacaagagcuaaccuucgaaaaauacaaagcaauaggccaaguuaaagagaaaauaauaaaaacaaauaacggacaaacgaaaacauuuaaagugauagcugauuggaguaaaagagaugaucauagacaucacgccauagacgcacucauaugugcacuaacagaccagaaaauaauauuuaaacuaaacaaccuaaacaaaauauaccaauaugaacgaaaugcccuaagucaaaaagaaaucgaagaaaucgaagaauuucuggaaggaaaauuuaguauaaaagaauuuagugcucaacaaggaaacauaauagaaugcaguauaccaaauauacgcaaagacgcacaaaaacacuuagaaaacauucugauaucguucaagaaagaaaauuccaaaguauugaccaugaacagaaaccaacccaaaaauuguaaagaacaaauaacuuggguaccacgcgcacgacuccaugaagacaccauaauggggaggguuaaaagaaucccagaaaagaaaaugaaauuaaaugauaaaguaucauucgaacaaauaaaaaugauaguaaacccagaaaucaaagaaauacucuuauacagacucgcaaaauuuggagacaacccaaaaguggcuuuugcaacuaaagcauuaaagaaagaacccauauuuuacagggaaaaugaacucaaagaagucucaauauacgaauggguuaauacaaaacguguggcacuuaacgaaaacauaaccgauucccaaauagagaaaauuauagaccaagcaucaaaaagagccguuaaagaaagacucaacggcggaaagauaaaagaaguauucaaaaaccuaacagaaaacccaauacaacucaaaaacggcaugauacucaaaaauguaaccguuacugaugaaaguaagguagagaaaauaagaaacggauucgcaauaaccggcaaaaaccaucacgcauuaguauauaaagaugaaaauggaaaauauaaugacaaaguaguuucauuuugggaagcgguagcaaucggauuaagaaacguaacagaguauggaaacccauauccaauaauaaacagaaaccauaaugacgaacucggagaauuuuacuucagcaugcaaauuaacgaccuguuugucuuugacuugaaacauucagaaaauccacaagaagaaaacgagauaaacuuuuucgacguagaaaaucgcaaacaaauauccgauaaauuauucagaguacagaaaaugagcaaaaagaguaauggacaauuuguguccgacuuuagacaucaccucgaaacaucaguaauuagaaaugauaugauucucaaaaauauaaccuggauaaguauaagcaaaaauucggaccucgagcgccucaccaaaauuagagucaaccacuuaggcgaaaucauaaaaguaggagaauga

SEQ ID NO: 5195 - RNA, 3585 nt, Artificial Sequence
  Cas9 variant
auggacuucacugcugacgucuccgaauuaaaugaauccuuuaugcagauacauacggaaucaaaauuugaaauugauaccgcaaaaguacaagaaauuucacaauugcuacuggacaacaaaauaacaagaauggacagacaaaaacaagucgcaaacguccuagcaaaaaacuccggcgacaaggaagcagacaaaauaaauaaaaaaaucgccaccgaauuuugcaaggcuguacuugggaacaaagcaaaauucaacguaauauuaggagaagaugcgguagauagugacuggucauucaaaauggacgaugaaaacagcgaugaggaaaucgaaauccucaugggacaaacuaauggacaacaacagaauguguugaggauaauacaccaaugguauucccaaauaacuuuaaauggaauagugccagacggacaaaugauaucggaauccaugaucgacaaauaugaauugcacagaaagcauuuauuauuacugaaacaacaaauaaaaguaacaaaagacaaaaaaaaagcacagcaauuacaugaagcauacgaacaauauguccacggaacaggagccaaaaaaaaauuaacacaagacgauuucuauucaaaaguuaccaaaaauuuagaaacaagugacuucucagacgaaauuaaaaaacaaaucaaugcagaaacauuuaugccaaaacagcgaacaucagcaaauggagugauaccgcaucaacugcaccaacaagaauuagacaaaauaauugaaaagcaagccaaguauuauccuuuuuuagcagaacuaaacccugacaccaaaaggcaaaacauagcaaaauauaaauuagacgaacuaauagcuuucaaaauacccuacuacguaggcccauuaauaacaacagaagaucagaagaaaacaagcgguaaaaguuucgccuggaugguaagaaaagaaccaggcaaaauaacuccauggaacuuugaucaaaaaguagacaaaauggcaagcgcagaccaauuuauaagaagaaugacuacgaaagacucauaccuuauaaccgaagacguacuaccagcggaaagucugauauaucaaaaauauaaaguccuaaaugaauuaaacaugauaagagucaacggaaacaaauuaacaaaacaugacaaacaaaacauauaucaacaaguuuucgaaaaauauaaaacuguuaacguaaaaaaaguucaaaauuacuuccuaacugauggacgauaucaacaugcuccaaaaauaaccggauuaagugaugacaacaaauuuaauucaaaucucucgaccuauauagacuucaaaaaaaucuuccaagauguaguagacgauccucaaaaacaaaaagauuuugaacgaauaaucgaauggucaacaaucuuugaagauagacacaucuaugaaguaaaauuaaaagaaaucaguuggcuuaaugaugagcaacgaaaagaauuaaagaaaaaaagacaucaaggauggggccgucuaucagccaaacuacuaacaggaaucuuugaugaaaacgguuacucaauaauggaucaacuauggaacacgcagaaaaacuucaugcaaauacaagcagaagaaggauucaacaaaaaaauucaagcagaaaacagcaaacauuuagaaaaaaacgauuucgaggacauacuugaagaugccuacacuucaccucaaaauaaaaaagcuauccggcaaguaaucaaaguaguagaagacauacaaaaaacaauggggacagcaccucagaagauauccauugaauucacacggucagccgauaaaaacccgcgacgaagcauagaaagacaaagacaauuagaagaaaucuacuacaaugacgcaaaagaaauaguaagcgaaggcaugcaagacaacuuacaaaacuuuacagacaacaagcagacccuuacugacaaauacuuccuguauuuuacccaacuagguaucgacauguacaccggaaaaaaaauaaauaucgaugaaaucgguaauuaccaaauugaucacauacuaccacaagccuucauaaaagacgacucuauagauaauaaaguacucgucagcucagcaauaaacaaugggaaaucagacaauguaccacucucaauguaugcauccgucagaaucaaaucagaagugcaaaacaaauggaagaacuucgcagaacacggccuaauaucccaaagaaaacuaaauaauuuaaugacagauccagaaaguauagauaaauauaaggcacgcgguuuuauuaaacggcaacuaguagaaaccucacaaguaauacgacuugucgccgaaaucuuaaaugagaaauaucaaggagaaacagaaauaauugaagucagagcaaaaaugaacagccaauuacgaaaagacuucgaucuacuuaaaaacagaaaugugaaugauuaccaucacgccuuagaugcguaccuaacgacauucaucgguaauuaccucuaccgcagauacccaaaauugcgauccuauuuuacuuauggucauuucaaaaagauagacgacgcuaaauuaaaacaguucaauuuuuuacacgacauagaaaaugacaaagaccccaaauacgugaaugacaauggugaacuacucugggaccgggaaaaagauaucgcguauuuuaaaaaaauauauaacuucaaauauaugcuaguaucacaugaaguaucaacaagacaaggagcaauguuuaaacaaacaauauucccagcagccgcggaugccaaaucaaaguugauaccaauaaaaaacgauaaaccaacagcgauauaugguggauauacaaauaacaacgacgcauaucuagcuauaauaaaacuugcaaaaacaggucaauuuaaaguagucggaguuccacagcgagcaauagucaaacuuaaacaggccuaugacaaagaaacuggcgauuauucaaacguucuuuauaaaguacuggaaccaaaauuuguuaaaaaaaaaguaaacagaaaaacuggagaaaucacauaccaaguugaaaaauuuaaaauaguagucccgaaagugccauacagacagcuaguuauagacggcgaucaaaaauucaugcuuggauccagcacauauaaauacaacgcuaaacaacuuguacuaucugaaaaugccaucaaaauauuagacaaaaaaagcuucgaucaaucuggauauaaaucaagcgaccucgauaccguauacgacgaaauacuaagccaagucgauagauacuuuucaauguaugauaaaaacaaauucagagaaggucuccauaaugguaaaaaauauuuccaacgauugcccaugauagauaauguagaaaagggcaaaauaaaagaaaauggaaaauuuaagcucuugaaugaaauacuaauuggauuacaugcaaaucccuccuuuggaaauuuaaaaagccuaggcauaucuacacccuucggaaugaugcaauucgcuucaggaauaagcuuaucggaaaaugccauccuaugcuaccaaagcccgacuggcauauucgaacgcagaguugcauuaaaagaucuauga

SEQ ID NO: 5196 - RNA, 3588 nt, Artificial Sequence
  Cas9 variant
augcaaaagaauauaaacacaaaacaaaaucacauauauauuaaacaagcacagaaaaucaaagaaaaacuaggugauaaacccuaucgaauaggacuagacuuaggcguagguucgaucggauuugcaauaguaaguauggaagaaaaugacggaaauguccuauuaccaaaagaaaucauuaugguaggaaguagaaucuucaaagcaagugcaggagccgcagauagaaaacuuucucgaggacaaagaaacaaucauaggcacacccgagaacggaugcgcuaucuauggaaagucuuggccgaacaaaaacuagcacuaccugugccugcagaccucgacagaaaagaaaauucuuccgagggagaaacaagcgcaaaaagauuccuaggagacguguuacaaaaagacauauacgagcuacgaguuaaaucucuagacgagcgauuaagucuacaagagcugggguacguguuauaccauauagcaggucacagaggaucuagcgcaauacguacauuugaaaacgacucugaagaagcacaaaaagaaaauaccgaaaacaaaaagauugcaggaaauaucaaaagacuaauggcgaagaaaaacuacaggaccuacggugaauaccuauauaaagaauuuuucgaaaacaaagaaaaacacaaaagagagaaaauaucgaacgcagcaaauaaccauaaauuuagcccaacaagagacuuagucauaaaagaagcggaagcaauacuuaagaaacaagcaggaaaagauggauuucacaaagaauuaaccgaagaauacauagaaaaacucaccaaagcuauaggauaugaauccgaaaaacucaucccggaaagcggauuuugccccuaucuuaaagacgagaaaagacuaccugcaucucacaaguuaaaugaagaaagaagacuaugggaaacauuaaacaacgcaagguacucagaucccaucguugacauagucacaggagaaaucacaggauauuaugaaaaacaauuuacuaaagaacaaaaacaaaaauuauucgacuaccuuuuaacagguagugaacuaacgccggcucaaacaaagaaauuacuagguuugaaaaauacaaacuucgaagacauaauauuacaagguagagauaagaaagcacagaaaauaaaaggauacaaacuaauuaaauuagaaaguaugccuuucugggcaagacuauccgaagcgcaacaagauucauuccuauacgacuggaacucauguccagacgaaaaacuacuaacagaaaaacuaaguaaugaauaucaccuaacagaagaggaaaucgauaaugcauucaacgaaauaguacuaaguaguucauaugcuccauuaggaaaaucagcaauguuaauuaucuuagagaaaauaaagaaugacuuauccuauacugaagcaguagaagaagcacuaaaagaaggaaaacuaacuaaagaaaaacaagcaauaaaagauagacucccauacuacggcgcaguauuacaagaaaguacucagaaaauuauagcaaaaggauucaguccacaauuuaaagauaaggguuauaaaacgccacauacaaauaaguaugaauuggaauacggaagaauagcaaauccaguuguacaucaaacgcuuaacgaauuacgcaaacuuguaaacgaaauaauagacauccuggguaaaaagccuugcgaaaucggauuagaaaccgcacgagaacuaaagaaaagcgcagaagauagaaguaaacugucaagagaacaaaacgacaacgaaucaaauagaaacagaauauaugaaauuuauauacgaccgcaacaacaaguaauaauaacuagaagagaaaacccaagaaacuauauccuuaaauucgagcuauuagaagaacaaaaaucccaauguccuuuuuguggcggacaaauaaguccaaaugacauuauaaauaaccaagccgacauagaacaccuauucccaauugcggaaucugaagacaauggaagaaacaacuuagugauaucccauucagcgugcaaugcugauaaagcaaaaagaagccccugggcagcauucgccucagccgcgaaagauagcaaauaugacuauaaccgaauauuaaguaauguaaaggaaaacaucccacacaaagccuggagauucaaucaaggagcauuugaaaaauucauugaaaauaaaccgauggcggcacgauuuaaaacagacaauagcuacauuagcaaagucgcacacaaauaucuagccugccuauucgagaaaccgaauauaauauguguaaaagggucucuaacggcucaacuucggauggcuuggggacuacaaggccugaugauaccuuucgcaaaacaacucauaacagaaaaagaaucagaaucauuuaauaaggacguaaacucaaauaagaaaaucagacuugauaauagacaucacgcacucgacgcaauagucaucgccuaugcaucacgaggauacggaaaucuucucaauaaaauggcgggcaaagauuacaaaauaaacuacucagaacggaacuggcuaaguaaaauccuucuaccuccaaacaauauaguuugggaaaacauagacgcagaccuggagagcuuugaaaguaguguaaaaacagcacucaaaaacgccuuuauaaguguaaaacacgaucacuccgauaauggcgagcuuguaaaaggaacaauguacaaaauauucuacuccgaacgagguuacacauuaacgacuuacaagaaacuaucagcauuaaaauuaacagacccgcagaaaaagaaaacaccaaaagauuuucuagaaacagcguuguuaaaauuuaaaggucgcgagucugaaaugaaaaacgagaaaauuaaaagcgcaauagaaaauaacaaacgauuauuugauguaauacaagacaacuuagaaaaagcaaagaaauuacuggaggaagaaaaugagaaaagcaaagcagaaggaaagaaagagaaaaauauaaaugacgcaucaaucuaccaaaaagcuauaagccucucuggagacaaauacguucaacuaaguaagaaagaacccggcaaauucuuugccaucucaaaaccaacuccaaccacuacaggauauggauaugauaccggagauucacucugcgucgaccuauauuacgacaacaaaggcaaacuuugcggagaaauaauucgaaaaauagaugcucaacagaaaaacccacugaaauacaaagaacaaggauuuacccuauuugagcgaauauaugggggcgacauacuugaaguagauuuugauauacauagugacaaaaacuccuucagaaacaauacuggaagcgccccagaaaacagagucuuuauaaaaguagguacauucacagaaauuaccaauaacaacauacaaauaugguuugguaacauaauaaaaagcaccgguggacaagacgacaguuucacgauaaacucaaugcagcaauacaauccaagaaaauuaauacuuagcucauguggauuuauaaaauauagguccccaauauuaaagaacaaagaaggauga

SEQ ID NO: 5197 - RNA, 3594 nt, Artificial Sequence
  Cas9 variant
augaguaaacaugucuuaggacuagaccuaggaguaggaucaauaggauggugucuuauagcauuagacgaacaagaucaaccggcugaaaucuuaggaauggggucaagaauugucccccugacgacagaugaccuuaaugaguucucccaaggaaaagcaaucagcaaaaaccaaaaacgcacaacacaaaggacuauaagaaaaggccuagaccgauaccaauuaagaaggaaaguacuuuccgaaaaacuagcagggcauggcaugcuuccagacaaagaucucaugcaguugccaguauuagaccuaugggaauuacgugcaagagccgcuagcccaggagaaaaauuaucauugccagaaauagguaggguacuauaccacauuaaucagaaaaggggcuauaaacacgcuaaaucagaugaagcagaagaaguaacuaaacgaggcaaagaacaaggcuauguagcaacagucaaagggagauacgcugaacuacaaagagaaggagcgacgguaggucaacacuuugcaugcaaauuaaaagaacacagacaagaaaguccuucuggcggauucuuuuauaauuauaggaucaaagaucaaguuuacccccgugaagcauauauugaagaauuugacaggauaauggaaguacaaaguguauuuuauccagaagugcuaaccccugcuuuuauacaagaacuacgagauaaagucauauucuuccaaaggccccuaaaaucuuguaaaggauuaguaaguuucugugaauuugaaaaacaagagagagugguacaauuaaaaagaguuaauagagaagguaaagaagaauugcaagaaagaaaaauuacaauugguccaaagguagcaccgaaaaguucacccauagcacaacucuguaaauuaugggaaucaauacauaacauaagaauuuauuauccagacggcaaagaaaggccgauuacacuagaggaaaagagaaaauuacuagcguacuuacaaacacaugauaaguuaacauucacagcauuaaagaaagaauuaaaaauaagcgacaaagaaagauuguggugugauaaauuacucaaaggaggaauaaaaggagauacuacgagaguuuuacuaagaaaagcauuagcuggauacaagagauacgaacccuuacuucggauggacuuagagcucagagacuuccaagagauagucucagguaaacgauugauuagaccaaucguagacgaaucguaccuuagccagccucuguauagacuauggcauauccuauauagcaucgaggaaagagaagcuaugcgcagagcucucauugaccaauuaggauuucuugaagaagauuuagacggaggacuacuugacaaauuauaucaaauugacuucgcaaagcagggauacagcaacaagagugccaaauuuauuuguaaacuucuaccccaccuacaagguggccacggguauucucaagcaugcgaauuagcaggaaaaagacacucagcaggaaguuugacaaaagaagaguuagaagaaagaccccuguuagaacauauaccauuauuacaauguaaugaacuuagacaaccaauaguagagaaaauuuuaaaccaaaugaucaauuugguaaaugcacuacgccagaaauauggcaguauugaugaaguaaggguagaacucgcaagagaauugaaaaugucgagggaagaaagagaagaaacaaguaaaaggaucagaagcagagaaaaggaaaacaaagaaauagcagaaagaauuaaagaauacgaacuauacccaacuaaaucacgcauucaaaaauauagacuauggcaggaagccggagaacaauguuuauauugcggaagaucaauugauguaguacaauuucuaagaggugauggaguugaaauagaacauauuaucccaaaaucaauacuauaugacgacucuuccgcuaauaaaaccugcgcuuguagucggugcaauaaagauaaagguaacagaaccgccuaugaauauauucuagcagaggguagagaagccgaauacuuagaccgacuugaaacguuguuccacgacggaaaacuaaguuauucgaaaaggagacgacuucaauggaagaaagcagacaucccaguugacuucauagaaagacaacucagauuaacacaauacauagcucgucaagcacaagaaaucuuaagacaaggaauacgaagaguaggugcuagcgaaggaagugucacagcaaaacugagacauuuaugggguuacgacgauauuuuaagggagcuaaacuucgaacgguaccaaaguaugggagagacggaaaucguaucucaggaagagaaagaugguucuauuacaaaaagugagagaauuaaagacuggucaaaaaggaaggaccauagacaccaugcaaucgaugcuuugguaguagcuuguaccagacaaggguauauacaaagacuaaauagccuuaacucagaagaagacaguuuacaaaugcaagaagauagcaaacaaaugagagagaaaaugggcggccaaaagagaccaacggcagauaaacauucgauauuagaaaacuggcuaauacuucaaccacacuucagucaucaagaaguaaaaagcaaagucgccgaaauauuagucaguuuuagacccgggaaaagaacaguauccacaggcagaaauacauaccuacgaucuggaaagaaaguaacacagagcgggguauuaauacccagaggacccuuauccgaagaaagccuauauggacaaauacuuaggaauggcgaaccaaccuauguaaagaaaguagcacuagaaucguuguccgaagcacaaauagaacaaauaguggacccaaaacuacgcagagaaaugguagcucguacacagccaagugagggagcuaaauuaaauccaaaauuacuacuugcuacaccauucuacagcgacgcggcagguacacaacguguacgcaguguaagggucgcaauagagaacggcaaaaacucuauaguaccacuacgguauaacgaaucaggaaaagcuauaacauucguuaacccuggaaauaaucaccauguuggaaucuacagaacgucugaaggcaaauuaguagaauccugcgucacuuucuggcaggcaguagaucgaguacgcuauggaauaccaacaauaauucgcaaaccuagagaaguauuagaucaacuucuucucagagacgacauacccgaagcauuauuagcacaucuaccagcgucagacugggaguucguugaauacuuacaagcuaacgaaauguuuuuaauaggucuaacugacgaagaaauacaaacagcauuagcggaaucggauuuauuaacauuauccaaucaccuauaucgcguucagaaaaugucuagcgaauacuauguauuucgguaucaucuagaaacagaaguagcagacaacaaaaauaauacagguauaauuccaaaauucuacagacuccgagggccaaaugauacauaucuaaaagcuaauccaagaaaaguaaaaguuaaucuuuuaggagaaauaagccuaccuuga

SEQ ID NO: 5198 - RNA, 3615 nt, Artificial Sequence
  Cas9 variant
auggaaagaauacuaggaauagauaccggcacaaacucacuaggaugggcaauaguugauaaagacgaaaaucaauaucaccuuguagcaaaagguacaaauauauucagugaaggaguaaagauugaaaaaggcauagaauccagcaaagcagcagaacgaacagaacauagaucaguuaggaaacauuauuggagacguaaaauacgaaaaauaagacucuuaacaauacuuucagauaacgaucuauguccaagacuaaaacacgaacaacuacgucaauggagauugaaaaagguauacccaacggacgacacauuuauggaauggcagagaacagaggacaaggcgcaaguaaauccauauaaauucagauauauuuguuuaacacaaaaacuagaucuauccgacaucacacaacguuuuauccucggucgagcacuuuaccaucuaaaucaaagacggggcuuccuaucaaacagaaaagaagcuacaaaagaaagugaagguacaguaaaagagggaauaucaucccugucaaaagauaugaaggacucaggaugcgaauaucugggagaguauuucuaccaauuauaucaacaaggcaagaagauaagaaaccacuacacagcacguaaagaacacuaccuaaaagaguucaaagcaaucugcucaaaacaagaauuagacgacgcauuaaucgaaaagcuggaaaaagccauauucgaccaaagacccuuaaaaucccaaaaaggacagguagggacaugcacauucgaaaaagguaagagccgaugcccaagcagccacccacucuaugaagacuuuagaauguacucauuuaucaauaacaucaaaguacagguugauacccuauaugacaaaggagaacgaucauugacagaugaggaaaaacaauuaauaauacccuuauucaaaagaaaaucuaaacgcacguuuccauucgaggauauagcuaagaaaauagcugguaaaaacaacuacugcuauauaaaaucaaacgaggaaaaggcuuauaaauuuaacuaccaaauggacacccaaguaaguggaagcccugucaacgcacaauuagaagagauauucggagaagauuggcuuuccuccguuugcgagguguacacuuuggcaaacaauaaaaguagauuccaaauaaugaacgauguauggcacguacuuuucuuuuacgacgacgaagacaaacuaaaagaguucgcaaaagaccgucuucaacuagacgaugaauuagcagaaaaauucucaaaaaucaguauucccaaugauuaugcugcauuaagccuaaaagcaauacggaaaauaaugccauauuuaagagacuauggauuaauuuauucagaagcaguauuucucgcaaauuuaguagauguacuaccacaacauguauggggaaucaaagaaaugcgagaagcggcaauagaaaaugugauagauguuaugcacagcuaugacaaaaacaauauagacggaauaacuuuagaaggaugcguuaaaacauuccucaaagaaagauaccaaguaucagaugacaaccuaaagaaacuguaucauccaagcauguuagauccauacccgaggcaacgaccuaacgacgaaggaguauuccaauuagguaguccacgcauaagcucagucaaaaacccaauggcaaugcacucauuauuccggcuacggaaaguaguaaaccuuaugcuuaagaaagguuauauaacccccgacacuaaaguacacauagaguucucacgcgacuuaaaugaugccaauaaaaggugggcaauccagacauggcaaagagaaaaugaaaaagaaagagaaagaugcagaaaagaaauagaaaaauacauagcauccccaucagauacagacauauuaaaauaucaacuaugggaagaacaaaaucauaaaugucuauacacaggagacgaaauuagaaucaccgacuucuuaggagauaauccuaaauaugauauagagcacaccaucccaagaucagccggaggcgauagcacaaaaaugaaccuuacacuaugcucaagcagguuuaacagagaugaaaagaaaacaaaacuaccagcagaacuuguuaaucacgacgaaauacuagaaagaaucuccaauuggaaagaaaaauacgaagauauagauaaacaaaucagaaaaauaagcacaaaaggugcaacaucgaaagaggacaaagacucaaaaauaagaagaagacacuacuuaauacuacaaagagacuauuggagaggcaaauaccaaagauuuacuaugacagaaguaccagaagguuucucacgaagacaaggaacagauaucaguguaauuagucguuaugcacguauguaccuaaaaucuguauucaaacaagucuacaucguaaaaggaauagcaaccucagauuucagaaaaauguggggcauccaagaugaguaugccaaaaaggaacgaguuaaucauguacaucacuguaucgaugcaauaacaauagccuguaucggaaaagcggaauacgauaaauuagcggacuaccgccaucaauacgacgauuaucucuuccaaggaaaaacuaaaccaaccuucgauaaaccauggccuucauuugugauagacaucaaacauauacaagacgaacuacuuauagcacauuacgcaaaagacaaucucgaaaaauucaccaagaaaaauuuaagaggcaaagacgguagaauaaucagagacaaauuuggaaacaaauuacaaaugaaaggugacacaucuagaaacagccuccacaacgacaaauucuauggugcgauuaaccacgaaggugaaauaaaauauguauaccgaacuaauauagaagccuuagaugccaaaagcauaggaaacauuguggacccaacaguuagaagcaucauagaaucagcaauugccauacauggcagucuaaaagcagcaaucaauaaaggaauauggaugaaugaagaaaaacauauaccaauaaagaaaguacgcgucuuccgaaaugacguaaagaaaccuauagaguuaaaagaccaaagagaucuuucagauaaagacuauaaacaacacuacuauguuacuaaugacggaaauuacaugaugcuaauauucagcaaauuaaauaauaaaggaagagaaauaagacaacauguaguaaucaacaguuuagaagcaacugaaguaaucaaaagccauaaaagaagccaagucggaaaaguaguaugggaaucauacuacaguaaagaaggcuucgaucuaauuuacaaauuaaaaagugggacuaugauauuauuauaugaaaacaauagagaugaaguuugggaccuagauauaagaaacuuacagaaaaggcucuacaucauaacgaagaugaaauacgaugggagaauauacaugaugcaccaucaagaagccagagagaaaaaggaccucgaagaaaagucaggcucauucaaaauaaaugaagauuacaggccacuuaucguaaacagcuacaaccaauucaacgccuuagugcaagaucucgauuucgaaaucaaugaccuuggagagaucagacgucugauauga
